US011781151B2

(12) United States Patent
Horn et al.

(10) Patent No.: US 11,781,151 B2
(45) Date of Patent: Oct. 10, 2023

(54) INSECTICIDAL CRY1B VARIANTS HAVING IMPROVED ACTIVITY SPECTRUM AND USES THEREOF

(71) Applicant: PIONEER HI-BRED INTERNATIONAL, INC., Johnston, IA (US)

(72) Inventors: Caroline Horn, Los Altos, CA (US); Sabina Lau, Cupertino, CA (US); Michi Izumi Willcoxon, Palo Alto, CA (US); Takashi Yamamoto, Dublin, CA (US); Yi Zheng, Palo Alto, CA (US)

(73) Assignee: PIONEER HI-BRED INTERNATIONAL, INC.

( * ) Notice: Subject to any disclaimer, the term of this patent is extended or adjusted under 35 U.S.C. 154(b) by 0 days.

(21) Appl. No.: 16/092,342

(22) PCT Filed: Apr. 12, 2017

(86) PCT No.: PCT/US2017/027160
§ 371 (c)(1),
(2) Date: Oct. 9, 2018

(87) PCT Pub. No.: WO2017/180715
PCT Pub. Date: Oct. 19, 2017

(65) Prior Publication Data
US 2020/0131528 A1    Apr. 30, 2020

Related U.S. Application Data

(60) Provisional application No. 62/322,535, filed on Apr. 14, 2016.

(51) Int. Cl.
*C12N 15/82* (2006.01)
*C07K 14/325* (2006.01)
*A01N 37/46* (2006.01)

(52) U.S. Cl.
CPC ......... *C12N 15/8286* (2013.01); *A01N 37/46* (2013.01); *C07K 14/325* (2013.01); *Y02A 40/146* (2018.01)

(58) Field of Classification Search
None
See application file for complete search history.

(56) References Cited

U.S. PATENT DOCUMENTS

| | | | |
|---|---|---|---|
| 5,723,758 A | 3/1998 | Payne et al. | |
| 7,790,846 B2 | 9/2010 | Flannagan et al. | |
| 8,692,065 B2 * | 4/2014 | Abad | A01N 63/10 800/279 |
| 8,735,560 B1 | 5/2014 | English et al. | |
| 10,669,555 B2 * | 6/2020 | Abad | C07K 14/325 |
| 11,028,407 B2 * | 6/2021 | Lu | C07K 14/325 |
| 2006/0112447 A1 | 5/2006 | Bogdanova et al. | |
| 2010/0192256 A1 | 7/2010 | Abad et al. | |
| 2010/0235951 A1 | 9/2010 | Van Rie et al. | |
| 2012/0311746 A1 | 12/2012 | Meade et al. | |
| 2014/0242048 A1 | 8/2014 | Ding et al. | |
| 2016/0194364 A1 | 7/2016 | Abad et al. | |
| 2017/0327547 A1 | 11/2017 | Baum et al. | |

FOREIGN PATENT DOCUMENTS

| | | | |
|---|---|---|---|
| WO | 95/04146 A2 | | 2/1995 |
| WO | 99/24581 A2 | | 5/1999 |
| WO | 01/14562 A2 | | 3/2001 |
| WO | 01/19859 A2 | | 3/2001 |
| WO | 2009/152023 A1 | | 12/2009 |
| WO | 2010/085295 A2 | | 7/2010 |
| WO | 2010/120452 A1 | | 10/2010 |
| WO | 2013/134734 A2 | | 9/2013 |
| WO | 2014/055881 A1 | | 4/2014 |
| WO | 2015/021139 A2 | | 2/2015 |
| WO | WO2015/021139 | * | 2/2015 |
| WO | WO/2015/021139 A2 | * | 2/2015 |
| WO | 2015/120276 A1 | | 8/2015 |

OTHER PUBLICATIONS

International Search Report for International Application No. PCT/US15/55491 dated Mar. 11, 2016.
International Search Report for International Application No. PCT/US17/27160 dated Oct. 2, 2017.
Bohorova, N. et al.; "Novel synthetic Bacillus thuringiensis cry1B gene and the cry1B-cry1Ab translational fusion confer resistance to southwestern corn borer, sugarcane borer and fall armyworm in transgenic tropical maize", Theor Appl Genet, 2001, vol. 103, pp. 817-826.
Bork, P et al; "Powers and Pitfalls in Sequence Analysis: The 70% Hurdle", Genome Research, 2000, vol. 10, pp. 398-400.
Bowie, et al.; "Deciphering the Message in Protein Sequences: Tolerance to Amino Acid Substitutions", Science, 1990, vol. 247, pp. 1306-1310.
Burgess, et al; "Possible dissociation of the heparin-binding and mitogenic activities of heparin-binding (acidic fibroblast) growth factor-1 from its receptor-binding activities by site-directed mutagenesis of a single lysine residue", Journal of Cell Biology, 1990, vol. 111, Issue 5, pp. 2129-2138.
Lazar, et al.; "Transforming Growth Factor α: Mutation of Aspartic Acid 47 and Leucine 48 Results in Different Biological Activities", Molecular and Cellular Biology, 1988, pp. 1247-1252.
Wagner, L, et al.; "Molecular Approaches to Improve the Insecticidal Activity of Bacillus thuringiensis Cry Toxins", Toxins, 2014, vol. 6, pp. 2393-2423.
Yamamoto; "Engineering of Bacillus thuringiensis insecticidal proteins", Journal of Pesticide Science, 2022 vol. 47, Issue 2, pp. 47-58.
International Search Report and Written Opinion for International Application No. PCT/US17/27160, dated Oct. 2, 2017.

* cited by examiner

*Primary Examiner* — Russell T Boggs

(57) ABSTRACT

The disclosure provides nucleic acids, and variants and fragments thereof, derived from strains of *Bacillus thuringiensis* encoding variant polypeptides having increased pesticidal activity against insect pests, including Lepidoptera and Coleopteran. Particular embodiments of the disclosure provide isolated nucleic acids encoding pesticidal proteins, pesticidal compositions, DNA constructs, and transformed microorganisms and plants comprising a nucleic acid of the embodiments. These compositions find use in methods for controlling pests, especially plant pests.

13 Claims, 28 Drawing Sheets

Specification includes a Sequence Listing.

Fig. 1A

```
                 1                                                    50
    Cry1Bd   (1) MTSNRKNENEIINALSIPAVSNHSAQMDLSLDARIEDSLCIAEGNNINPL
   IP1B-B1   (1) MPSNRKNENEIIN-----AVSNHSAQMDLSLDARIEDSLCVAEVNNIDPF
     MP258   (1) M SNRKNENEIINALSIPAVSNHSAQMDLSPDARIEDSLCIAEGNNINPL
  IP1B-B21   (1) MPSNRKNENEIINALSIPAVSNHSAQMDLSLDARIEDSLCIAEGNNINPL
  IP1B-B22   (1) MPSNRKNENGIINALSIPAVSNHSAQMDLSPDARIEDSLCVAEVNNIDPF
  IP1B-B23   (1) MPSNRKNENEIIN-----AVSNHSAQMDLSPDARIEDSLCVAEVNNIDPF
  IP1B-B24   (1) MPSNRKNENEIINALSIPAVSNHSAQMDLSLDARIEDSLCIAEGNNINPL
  IP1B-B25   (1) MPSNRKNENEIINALSIPAVSNHSAQMDLSLDARIEDSLCIAEGNNINPL
  IP1B-B26   (1) MPSNRKNENEIINALSIPAVSNHSAQMDLSLDARIEDSLCIAEGNNINPL
  IP1B-B27   (1) MPSNRKNENEIINALSIPAVSNHSAQMDLSLDARIEDSLCIAEGNNINPL
  IP1B-B28   (1) MPSNRKNENEIINALSIPAVSNHSAQMDLSLDARIEDSLCIAEGNNINPL
  IP1B-B29   (1) MPSNRKNENEIINALSIPAVSNHSAQMDLSLDARIEDSLCIAEGNNINPL
  IP1B-B40   (1) MPSNRKNENEIINALSIPAVSNHSAQMDLSLDARIEDSLCIAEGNNINPL
  IP1B-B41   (1) MPSNRKNENEIINALSIPAVSNHSAQMDLSLDARIEDSLCIAEGNNINPL
  IP1B-B42   (1) MPSNRKNENEIINALSIPAVSNHSAQMDLSLDARIEDSLCIAEGNNINPL
  IP1B-B43   (1) MPSNRKNENEIINALSIPAVSNHSAQMDLSLDARIEDSLCIAEGNNINPL
  IP1B-B44   (1) MPSNRKNENEIINALSIPAVSNHSAQMDLSLDARIEDSLCIAEGNNINPL
  IP1B-B45   (1) MPSNRKNENEIINALSIPAVSNHSAQMDLSLDARIEDSLCIAEGNNINPL
  IP1B-B46   (1) MPSNRKNENEIINALSIPAVSNHSAQMDLSLDARIEDSLCIAEGNNINPL
  IP1B-B47   (1) MPSNRKNENEIINALSIPAVSNHSAQMDLSLDARIEDSLCIAEGNNINPL
  IP1B-B31   (1) MPSNRKNENEIIN-----AVSNHSAQMDLSLDARIEDSLCVAEVNNIDPF
  IP1B-B32   (1) MPSNRKNENEIIN-----AVSNHSAQMDLSLDARIEDSLCVAEVNNIDPF
  IP1B-B33   (1) MPSNRKNENHIIN-----AVSNHSAQMDLSLDARIEDSLCVAEVNNIDPF
  IP1B-B34   (1) MPSNRKNENEIIN-----AVSNHSAQMDLSLDARIEDSLCVAEVNNIDPF
     GS060   (1) MPSNRKNENEIINALSIPAVSNHSAQMDLSPDARIEDSLCVAEGNNIDPF 51                                                  100
    Cry1Bd  (51) VSASTVQTGINIAGRILGVLGVPFAGQLASFYSFLVGELWPSGRDPWEIF
   IP1B-B1  (46) VSASTVQTGISIAGRILGVLGVPFAGQLASFYSFLVGELWPSGRDPWEIF
     MP258  (51) VSASTVQTGINIAGRILGVLGVPFAGQLASFYSFIVGELWPSGRDPWEIF
  IP1B-B21  (51) VSASTVQTGINIAGRILGVLGVPFAGQLASFYSFIVGELWPSGRDPWEIF
  IP1B-B22  (51) VSASTVQTGINIAGRILGVLGVPFAGQLASFYSFIVGELWPSGRDPWEIF
  IP1B-B23  (46) VSASTVQTGINIAGRILGVLGVPFAGQLASFYSFLVGELWPSGRDPWEIF
  IP1B-B24  (51) VSASTVQTGINIAGRILGVLGVPFAGQLASFYSFIVGELWPSGRDPWEIF
  IP1B-B25  (51) VSASTVQTGINIAGRILGVLGVPFAGQLASFYSFIVGELWPSGRDPWEIF
  IP1B-B26  (51) VSASTVQTGINIAGRILGVLGVPFAGQLASFYSFIVGELWPSGRDPWEIF
  IP1B-B27  (51) VSASTVQTGINIAGRILGVLGVPFAGQLASFYSFIVGELWPSGRDPWEIF
  IP1B-B28  (51) VSASTVQTGINIAGRILGVLGVPFAGQLASFYSFIVGELWPSGRDPWEIF
  IP1B-B29  (51) VSASTVQTGINIAGRILGVLGVPFAGQLASFYSFIVGELWPSGRDPWEIF
  IP1B-B40  (51) VSASTVQTGINIAGRILGVLGVPFAGQLASFYSFIVGELWPSGRDPWEIF
  IP1B-B41  (51) VSASTVQTGINIAGRILGVLGVPFAGQLASFYSFIVGELWPSGRDPWEIF
  IP1B-B42  (51) VSASTVQTGINIAGRILGVLGVPFAGQLASFYSFIVGELWPSGRDPWEIF
  IP1B-B43  (51) VSASTVQTGINIAGRILGVLGVPFAGQLASFYSFIVGELWPSGRDPWEIF
  IP1B-B44  (51) VSASTVQTGINIAGRILGVLGVPFAGQLASFYSFIVGELWPSGRDPWEIF
  IP1B-B45  (51) VSASTVQTGINIAGRILGVLGVPFAGQLASFYSFIVGELWPSGRDPWEIF
  IP1B-B46  (51) VSASTVQTGINIAGRILGVLGVPFAGQLASFYSFIVGELWPSGRDPWEIF
  IP1B-B47  (51) VSASTVQTGINIAGRILGVLGVPFAGQLASFYSFIVGELWPSGRDPWEIF
  IP1B-B31  (46) VSASTVQTGISIAGRILGVLGVPFAGQLASFYSFLVGELWPSGRDPWEIF
  IP1B-B32  (46) VSASTVQTGISIAGRILGVLGVPFAGQLASFYSFLVGELWPSGRDPWEIF
  IP1B-B33  (46) VSASTVQTGINIAGRILGVLGVPFAGQLASFYSFLVGELWPSGRDPWEIF
  IP1B-B34  (46) VSASTVQTGISIAGRILGVLGVPFAGQLASFYSFLVGELWPSGRDPWEIF
     GS060  (51) VSASTVQTGISIAGRILGVLGVPFAGQLASFYSFLVGELWPSGRDPWEIF
```

Fig. 1B

```
                  101                                                150
    Cry1Bd  (101) LEHVEQLIRQQVTENTRNTAIARLEGLGRGYRSYQQALETWLDNRNDARS
    IP1B-B1  (96) MEHVEQIVRQQITDSVRDTAIARLEGLGRGYRSYQQALETWLDNRNDARS
    MP258   (101) LEHVEQLVRQQITENARNTALARLQGLGASFRAYQQSLEDWLENRDDART
    IP1B-B21(101) MEHVEQLVRQQITENARNTALARLQGLGASFRAYQQSLEDWLENRDNART
    IP1B-B22(101) LEHVEQLVRQQITENARNTALARLQGLGASFRAYQQSLEDWLENRDDART
    IP1B-B23 (96) MEHVEQLVRQQITENARNTALARLQGLGASFRAYQQSLEDWLENRDDART
    IP1B-B24(101) MEHVEQLVRQQITENARNTALARLQGLGASFRAYQQSLEDWLENRDNART
    IP1B-B25(101) MEHVEQLVRQQITENARNTALARLQGLGASFRAYQQSLEDWLENRDNART
    IP1B-B26(101) MEHVEQLVRQQITENARNTALARLQGLGASFRAYQQSLEDWLENRDNART
    IP1B-B27(101) MEHVEQLVRQAITLNARNTALARLQGLGASFRAYQQSLEDWLENRDNART
    IP1B-B28(101) MEHVEQLVRQAITLNARNTALARLQGLGASFRAYQQSLEDWLENRDNART
    IP1B-B29(101) MEHVEQLVRQAITLNARNTALARLQGLGASFRAYQQSLEDWLENRDNART
    IP1B-B40(101) MEHVEQLVRQHITENARNTALARLQGLGASFRAYQQSLEDWLENRDNART
    IP1B-B41(101) MEHVEQLVRQHITENARNTALARLQGLGASFRAYQQSLEDWLENRDNART
    IP1B-B42(101) MEHVEQLVRQMITLNARNTALARLQGLGASFRAYQQSLEDWLENRDNART
    IP1B-B43(101) MEHVEQLVRQMITMNARNTALARLQGLGASFRAYQQSLEDWLENRDNART
    IP1B-B44(101) MEHVEQLVRQMITHNARNTALARLQGLGASFRAYQQSLEDWLENRDNART
    IP1B-B45(101) MEHVEQLVRQHITMNARNTALARLQGLGASFRAYQQSLEDWLENRDNART
    IP1B-B46(101) MEHVEQLVRQMITHNARNTALARLQGLGASFRAYQQSLEDWLENRDNART
    IP1B-B47(101) MEHVEQLVRQHITMNARNTALARLQGLGASFRAYQQSLEDWLENRDNART
    IP1B-B31 (96) MEHVEQIVRQQITDSVRDTAIARLEGLGRGYRSYQQALETWLDNRNDARS
    IP1B-B32 (96) MEHVEQIVRQQITDSVRDTAIARLEGLGRGYRSYQQALETWLDNRNDARS
    IP1B-B33 (96) MEHVEQIVRQQITDSVRDTAIARLEGLGRGYRSYQQALETWLDNRNDARS
    IP1B-B34 (96) LEHVEQLIRQQVTENTRNTAIARLEGLGRGYRSYQQALETWLDNRNDARS
    GS060   (101) MEHVEQIVRQQITDSVRDTAIARLEGLGRGYRSYQQALETWLDNRNDARS 151                                                200
    Cry1Bd  (151) RSIILERYVALELDITTAIPLFRIRNEEVPLLMVYAQAANLHLLLLRDAS
    IP1B-B1 (146) RSIIRERYIALELDITTAIPLFSIRNQEVPLLMVYAQAANLHLLLLRDAS
    MP258   (151) RSVLYTQYIALELDFLNAMPLFAINNQQVPLLMVYAQAANLHLLLLRDAS
    IP1B-B21(151) RSVLYTQYIALELDFLNAMPLFAINNQQVPLLMVYAQAANLHLLLLRDAS
    IP1B-B22(151) RSVLYTQYIALELDFLNAMPLFAINNQRVPLLMVYAQAANLHLLLLRDAS
    IP1B-B23(146) RSVLYTQYIALELDFLNAMPLFAINNQQVPLLMVYAQAANLHLLLLRDAS
    IP1B-B24(151) RSVLYTQYIALELDFLNAMPLFAINNQQVPLLMVYAQAANLHLLLLRDAS
    IP1B-B25(151) RSVLYTQYIALELDFLNAMPLFAINNQQVPLLMVYAQAANLHLLLLRDAS
    IP1B-B26(151) RSVLYTQYIALELDFLNAMPLFAINNQQVPLLMVYAQAANLHLLLLRDAS
    IP1B-B27(151) RSVLYTQYIALELDFLNAMPLFAINNQQVPLLMVYAQAANLHLLLLRDAS
    IP1B-B28(151) RSVLYTQYIALELDFLNAMPLFAINNQQVPLLMVYAQAANLHLLLLRDAS
    IP1B-B29(151) RSVLYTQYIALELDFLNAMPLFAINNQQVPLLMVYAQAANLHLLLLRDAS
    IP1B-B40(151) RSVLYTQYIALELDFLNAMPLFAINNQQVPLLMVYAQAANLHLLLLRDAS
    IP1B-B41(151) RSVLYTQYIALELDFLNAMPLFAINNQQVPLLMVYAQAANLHLLLLRDAS
    IP1B-B42(151) RSVLYTQYIALELDFLNAMPLFAINNQQVPLLMVYAQAANLHLLLLRDAS
    IP1B-B43(151) RSVLYTQYIALELDFLNAMPLFAINNQQVPLLMVYAQAANLHLLLLRDAS
    IP1B-B44(151) RSVLYTQYIALELDFLNAMPLFAINNQQVPLLMVYAQAANLHLLLLRDAS
    IP1B-B45(151) RSVLYTQYIALELDFLNAMPLFAINNQQVPLLMVYAQAANLHLLLLRDAS
    IP1B-B46(151) RSVLYTQYIALELDFLNAMPLFAINNQQVPLLMVYAQAANLHLLLLRDAS
    IP1B-B47(151) RSVLYTQYIALELDFLNAMPLFAINNQQVPLLMVYAQAANLHLLLLRDAS
    IP1B-B31(146) RSIIRERYIALELDITTAIPLFSIRNQEVPLLMVYAQAANLHLLLLRDAS
    IP1B-B32(146) RSIIRERYIALELDITTAIPLFSIRNQEVPLLMVYAQAANLHLLLLRDAS
    IP1B-B33(146) RSIILERYIALELDITTAIPLFSIRNQEVPLLMVYAQAANLHLLLLRDAS
    IP1B-B34(146) RSIILERYVALELDITTAIPLFSIRNQEVPLLMVYAQAANLHLLLLRDAS
    GS060   (151) RSIIRERYIALELDITTAIPLFSIRNQEVPLLMVYAQAANLHLLLLRDAS
```

Fig. 1C

```
             201                                                        250
Cry1Bd  (201) LFGSEWGMASSDVNQYYQEQIRYTEEYSNHCVQWYNTGLNNLRGTNAESW
IP1B-B1 (196) LFGSEWGMSSSDVNQYYQEQIRYTEEYSNHCVQWYNTGLNNLRGTNAESW
MP258   (201) LFGSEFGLTSQEIQRYYERQAEKTREYSDYCARWYNTGLNNLRGTNAESW
IP1B-B21 (201) LFGSEFGLTSQEIQRYYERQAEKTREYSDYCARWYNTGLNNLRGTNAESW
IP1B-B22 (201) LFGSEFGLTSQEIQRYYERQAEKTREYSDYCARWYNTGLNNLRGTNAESW
IP1B-B23 (196) LFGSEFGLTSQEIQRYYERQAEKTREYSDYCARWYNTGLNNLRGTNAESW
IP1B-B24 (201) LFGSEFGLTSQEIQRYYERQAEKTREYSDYCARWYNTGLNNLRGTNAESW
IP1B-B25 (201) LFGSEFGLTSQEIQRYYERQAEKTREYSDYCARWYNTGLNNLRGTNAESW
IP1B-B26 (201) LFGSEFGLTSQEIQRYYERQAEKTREYSDYCARWYNTGLNNLRGTNAESW
IP1B-B27 (201) LFGSEFGLTSQEIQRYYERQAEKTREYSDYCARWYNTGLNNLRGTNAESW
IP1B-B28 (201) LFGSEFGLTSQEIQRYYERQAEKTREYSDYCARWYNTGLNNLRGTNAESW
IP1B-B29 (201) LFGSEFGLTSQEIQRYYERQAEKTREYSDYCARWYNTGLNNLRGTNAESW
IP1B-B40 (201) LFGSEFGLTSQEIQRYYERQAEKTREYSDYCARWYNTGLNNLRGTNAESW
IP1B-B41 (201) LFGSEFGLTSQEIQRYYERQAEKTREYSDYCARWYNTGLNNLRGTNAESW
IP1B-B42 (201) LFGSEFGLTSQEIQRYYERQAEKTREYSDYCARWYNTGLNNLRGTNAESW
IP1B-B43 (201) LFGSEFGLTSQEIQRYYERQAEKTREYSDYCARWYNTGLNNLRGTNAESW
IP1B-B44 (201) LFGSEFGLTSQEIQRYYERQAEKTREYSDYCARWYNTGLNNLRGTNAESW
IP1B-B45 (201) LFGSEFGLTSQEIQRYYERQAEKTREYSDYCARWYNTGLNNLRGTNAESW
IP1B-B46 (201) LFGSEFGLTSQEIQRYYERQAEKTREYSDYCARWYNTGLNNLRGTNAESW
IP1B-B47 (201) LFGSEFGLTSQEIQRYYERQAEKTREYSDYCARWYNTGLNNLRGTNAESW
IP1B-B31 (196) LFGSEWGMSSSDVNQYYQEQIRYTEEYSNHCVQWYNTGLNNLRGTNAESW
IP1B-B32 (196) LFGSEWGMSSSDVNQYYQEQIRYTEEYSNHCVQWYNTGLNNLRGTNAESW
IP1B-B33 (196) LFGSEWGMASSDVNQYYQEQIRYTEEYSNHCVQWYNTGLNNLRGTNAESW
IP1B-B34 (196) LFGSEWGMSSADVNQYYQEQIRYTEEYSNHCVQWYNTGLNNLRGTNAESW
GS060    (201) LFGSEWGMSSADVNQYYQEQIRYTEEYSNHCVQWYNTGLNRLRGTTAESW 251                                                        300
Cry1Bd  (251) LRYNQFRRDLTLGVLDLVALFPSYDTRTYPINTSAQLTREIYTDPIGRTN
IP1B-B1 (246) LRYNQFRRDLTLGVLDLVALFPSYDTRVYPMNTSAQLTREIYTDPIGRTN
MP258   (251) LRYNQFRRDLTLGVLDLVALFPSYDTRIYPINTSAQLTREIYTDPIGRTN
IP1B-B21 (251) LRYNQFRRDLTLGVLDLVALFPSYDTRIYPINTSAQLTREIYTDPIGRTN
IP1B-B22 (251) LRYNQFRRDLTLGVLDLVALFPSYDTRVYPMNTSAQLTREIYTDPIGRTN
IP1B-B23 (246) LRYNQFRRDLTLGVLDLVALFPSYDTRIYPINTSAQLTREIYTDPIGRTN
IP1B-B24 (251) LRYNQFRRDLTLGVLDLVALFPSYDTRIYPINTSAQLTREIYTDPIGRTN
IP1B-B25 (251) LRYNQFRRDLTLGVLDLVALFPSYDTRIYPINTSAQLTREIYTDPIGRTN
IP1B-B26 (251) LRYNQFRRDLTLGVLDLVALFPSYDTRIYPINTSAQLTREIYTDPIGRTN
IP1B-B27 (251) LRYNQFRRDLTLGVLDLVALFPSYDTRIYPINTSAQLTREIYTDPIGRTN
IP1B-B28 (251) LRYNQFRRDLTLGVLDLVALFPSYDTRIYPINTSAQLTREIYTDPIGRTN
IP1B-B29 (251) LRYNQFRRDLTLGVLDLVALFPSYDTRIYPINTSAQLTREIYTDPIGRTN
IP1B-B40 (251) LRYNQFRRDLTLGVLDLVALFPSYDTRIYPINTSAQLTREIYTDPIGRTN
IP1B-B41 (251) LRYNQFRRDLTLGVLDLVALFPSYDTRIYPINTSAQLTREIYTDPIGRTN
IP1B-B42 (251) LRYNQFRRDLTLGVLDLVALFPSYDTRIYPINTSAQLTREIYTDPIGRTN
IP1B-B43 (251) LRYNQFRRDLTLGVLDLVALFPSYDTRIYPINTSAQLTREIYTDPIGRTN
IP1B-B44 (251) LRYNQFRRDLTLGVLDLVALFPSYDTRIYPINTSAQLTREIYTDPIGRTN
IP1B-B45 (251) LRYNQFRRDLTLGVLDLVALFPSYDTRIYPINTSAQLTREIYTDPIGRTN
IP1B-B46 (251) LRYNQFRRDLTLGVLDLVALFPSYDTRIYPINTSAQLTREIYTDPIGRTN
IP1B-B47 (251) LRYNQFRRDLTLGVLDLVALFPSYDTRIYPINTSAQLTREIYTDPIGRTN
IP1B-B31 (246) LRYNQFRRDLTLGVLDLVALFPSYDTRVYPMNTSAQLTREIYTDPIGRTN
IP1B-B32 (246) LRYNQFRRDLTLGVLDLVALFPSYDTRTYPINTSAQLTREIYTDPIGRTN
IP1B-B33 (246) LRYNQFRRDLTLGVLDLVALFPSYDTRTYPINTSAQLTREIYTDPIGRTN
IP1B-B34 (246) LRYNQFRRDLTLGVLDLVALFPSYDTRTYPINTSAQLTREIYTDPIGRTN
GS060    (251) VRYNQFRRDLTLGVLDLVALFPSYDTRTYPIPTTAQLTREVYTDPNGVVA
```

Fig. 1D

```
             301                                                350
Cry1Bd (301) APSGFASTNWFNNNAPSFSAIEAAIFRPPHLLDFPEQLTIYSASSRWSST
IP1B-B1 (296) APSGFASTNWFNNNAPSFSAIEAAIFRPPHLLDFPEQLTIYSASSRWSST
 MP258 (301) APSGFASTNWFNNNAPSFSAIEAAVIRPPHLLDFPEQLTIFSVLSRWSNT
IP1B-B21 (301) APSGFASTNWFNNNAPSFSAIEAAIFRPPHLLDFPEQLTIYSASSRWSST
IP1B-B22 (301) APSGFASTNWFNNNAPSFSAIEAAVIRPPHLLDFPEQLTIFSVLSRWSST
IP1B-B23 (296) APSGFASTNWFNNNAPSFSAIEAAVIRPPHLLDFPEQLTIYSASSRWSST
IP1B-B24 (301) APSGFASTNWFNNNAPSFSAIEAAIFRPPHLLDFPEQLTIYSASSRWSST
IP1B-B25 (301) APSGFASTNWFNNNAPSFSAIEAAIFRPPHLLDFPEQLTIYSASSRWSST
IP1B-B26 (301) APSGFASTNWFNNNAPSFSAIEAAIFRPPHLLDFPEQLTIYSASSRWSST
IP1B-B27 (301) APSGFASTNWFNNNAPSFSAIEAAIFRPPHLLDFPEQLTIYSASSRWSST
IP1B-B28 (301) APSGFASTNWFNNNAPSFSAIEAAIFRPPHLLDFPEQLTIYSASSRWSST
IP1B-B29 (301) APSGFASTNWFNNNAPSFSAIEAAIFRPPHLLDFPEQLTIYSASSRWSST
IP1B-B40 (301) APSGFASTNWFNNNAPSFSAIEAAIFRPPHLLDFPEQLTIYSASSRWSST
IP1B-B41 (301) APSGFASTNWFNNNAPSFSAIEAAIFRPPHLLDFPEQLTIYSASSRWSST
IP1B-B42 (301) APSGFASTNWFNNNAPSFSAIEAAIFRPPHLLDFPEQLTIYSASSRWSST
IP1B-B43 (301) APSGFASTNWFNNNAPSFSAIEAAIFRPPHLLDFPEQLTIYSASSRWSST
IP1B-B44 (301) APSGFASTNWFNNNAPSFSAIEAAIFRPPHLLDFPEQLTIYSASSRWSST
IP1B-B45 (301) APSGFASTNWFNNNAPSFSAIEAAIFRPPHLLDFPEQLTIYSASSRWSST
IP1B-B46 (301) APSGFASTNWFNNNAPSFSAIEAAIFRPPHLLDFPEQLTIYSASSRWSST
IP1B-B47 (301) APSGFASTNWFNNNAPSFSAIEAAIFRPPHLLDFPEQLTIYSASSRWSST
IP1B-B31 (296) APSGFASTNWFNNNAPSFSAIEAAIFRPPHLLDFPEQLTIYSASSRWSST
IP1B-B32 (296) APSGFASTNWFNNNAPSFSAIEAAIFRPPHLLDFPEQLTIYSASSRWSST
IP1B-B33 (296) APSGFASTNWFNNNAPSFSAIEAAIFRPPHLLDFPEQLTIYSASSRWSST
IP1B-B34 (296) APSGFASTNWFNNNAPSFSAIEAAIFRPPHLLDFPEQLTIYSASSRWSST
 GS060 (301) GPN--NS--WFRN-GASFSAIENAIIRQPHLYDFLTNLTIYTRRS-QVGT 351                                                400
Cry1Bd (351) QHMNYWVGHRLNFRPIGGTLNTSTQGLTNNTSINPVTLQFTSRDVYRTES
IP1B-B1 (346) QHMNYWVGHRLNFRPIGGTLNTSTHGATN-TSINPVTLQFTSRDVYRTES
 MP258 (351) QYMNYWVGHRLNSRNIIGSLNTSTHGNTN-TSINPVTLQFTSRDVYRTES
IP1B-B21 (351) QHMNYWVGHRLESRTIRGSLSTSTHGNTN-TSINPVTLQFTSRDVYRTES
IP1B-B22 (351) QHMNYWVGHRLESRTIRGSLSTSTHGNTN-TSINPVTLQFTSRDVYRTES
IP1B-B23 (346) QHMNYWVGHRLNFRPIGGTLNTSTHGATN-TSINPVTLQFTSRDVYRTES
IP1B-B24 (351) QHMNYWVGHRLNFRPIGGTLNTSTHGATN-TSINPVTLQFTSRDVYRTES
IP1B-B25 (351) QHMNYWVGHRLNFRPIGGTLNTSTHGATN-TSINPVTLQFTSRDVYRTES
IP1B-B26 (351) QHMNYWVGHRLNFRPIGGTLNTSTHGATN-TSINPVTLQFTSRDVYRTES
IP1B-B27 (351) QHMNYWVGHRLNFRPIGGTLNTSTHGATN-TSINPVTLQFTSRDVYRTES
IP1B-B28 (351) QHMNYWVGHRLYFRPINGTLNTSTHGATN-TSINPVTLQFTSRDVYRTES
IP1B-B29 (351) QHMNYWVGHRLYFRPIQGTLNTSTHGATN-TSINPVTLQFTSRDVYRTES
IP1B-B40 (351) QHMNYWVGHRLNFRPIHGTLNTSTHGATN-TSINPVTLQFTSRDVYRTES
IP1B-B41 (351) QHMNYWVGHRLNFRPIHGTLNTSTHGATN-TSINPVTLQFTSRDVYRTES
IP1B-B42 (351) QHMNYWVGHRLNFRPIGGTLNTSTHGATN-TSINPVTLQFTSRDVYRTES
IP1B-B43 (351) QHMNYWVGHRLNFRPIGGTLNTSTHGATN-TSINPVTLQFTSRDVYRTES
IP1B-B44 (351) QHMNYWVGHRLNFRPIGGTLNTSTHGATN-TSINPVTLQFTSRDVYRTES
IP1B-B45 (351) QHMNYWVGHRLNFRPIGGTLNTSTHGATN-TSINPVTLQFTSRDVYRTES
IP1B-B46 (351) QHMNYWVGHRLNFRPINGTLNTSTHGATN-TSINPVTLQFTSRDVYRTES
IP1B-B47 (351) QHMNYWVGHRLNFRPINGTLNTSTHGATN-TSINPVTLQFTSRDVYRTES
IP1B-B31 (346) QHMNYWVGHRLNFRPIGGTLNTSTQGLTNNTSINPVTLQFTSRDVYRTES
IP1B-B32 (346) QHMNYWVGHRLNFRPIGGTLNTSTQGLTNNTSINPVTLQFTSRDVYRTES
IP1B-B33 (346) QHMNYWVGHRLNFRPIGGTLNTSTQGLTNNTSINPVTLQFTSRDVYRTES
IP1B-B34 (346) QHMNYWVGHRLNFRPIGGTLNTSTQGLTNNTSINPVTLQFTSRDVYRTES
 GS060 (345) TIMNLWAGHRITNRIQGGSTSEMVYGAITNPVSVSDIPFVNRDVYRTVS
```

Fig. 1E

```
              401                                                450
  Cry1Bd (401) NAGTNILFTTPVNGVPWARFNFINPQNIYERGATTYSQPYQGVGIQLFDS
 IP1B-B1  (395) FAGTNILFTTPVNGVPWARFNFINPQNIYERGATTYSQPYQGVGIQLFDS
   MP258  (400) YAGINILLTTPVNGVPWARFNWRNPLNSLR-GSLLYTIGYTGVGTQLFDS
 IP1B-B21 (400) YAGINILLTTPVNGVPWARFNWRNPLNSLR-GSLLYTIGYTGVGTQLFDS
 IP1B-B22 (400) YAGINILLTTPVNGVPWARFNWRNPLNSLR-GSLLYTIGYTGVGTQLFDS
 IP1B-B23 (395) YAGINILLTTPVNGVPWARFNWRNPLNSLR-GSLLYTIGYTGVGIQLFDS
 IP1B-B24 (400) YAGINILLTTPVNGVPWARFNWRNPLNSLR-GSLLYTIGYTGVGTQLFDS
 IP1B-B25 (400) YAGINILLTTPVNGVPWARFNWRNPLNSLR-GSLLYTIGYTGVGTQLFDS
 IP1B-B26 (400) YAGINILLTTPVNGVPWARFNWRNPLNSLR-GSLLYTIGYTGVGTQLFDS
 IP1B-B27 (400) YAGINILLTTPVNGVPWARFNWRNPLNSLR-GSLLYTIGYTGVGTQLFDS
 IP1B-B28 (400) YAGINILLTTPVNGVPWARFNWRNPLNSLR-GSLLYTIGYTGVGTQLFDS
 IP1B-B29 (400) YAGINILLTTPVNGVPWARFNWRNPLNSLR-GSLLYTIGYTGVGTQLFDS
 IP1B-B40 (400) YAGINILLTTPVNGVPWARFNWRNPLNSLR-GSLLYTIGYTGVGTQLFDS
 IP1B-B41 (400) YAGINILLTTPVNGVPWARFNWRNPLNSLR-GSLLYTIGYTGVGTQLFDS
 IP1B-B42 (400) YAGINILLTTPVNGVPWARFNWRNPLNSLR-GSLLYTIGYTGVGTQLFDS
 IP1B-B43 (400) YAGINILLTTPVNGVPWARFNWRNPLNSLR-GSLLYTIGYTGVGTQLFDS
 IP1B-B44 (400) YAGINILLTTPVNGVPWARFNWRNPLNSLR-GSLLYTIGYTGVGTQLFDS
 IP1B-B45 (400) YAGINILLTTPVNGVPWARFNWRNPLNSLR-GSLLYTIGYTGVGTQLFDS
 IP1B-B46 (400) YAGINILLTTPVNGVPWARFNWRNPLNSLR-GSLLYTIGYTGVGTQLFDS
 IP1B-B47 (400) YAGINILLTTPVNGVPWARFNWRNPLNSLR-GSLLYTIGYTGVGTQLFDS
 IP1B-B31 (396) NAGTNILFTTPVNGVPWARFNFINPQNIYERGATTYSQPYQGVGIQLFDS
 IP1B-B32 (396) NAGTNILFTTPVNGVPWARFNFINPQNIYERGATTYSQPYQGVGIQLFDS
 IP1B-B33 (396) NAGTNILFTTPVNGVPWARFNFINPQNIYERGATTYSQPYQGVGIQLFDS
 IP1B-B34 (396) NAGTNILFTTPVNGVPWARFNFINPQNIYERGATTYSQPYQGVGIQLFDS
   GS060  (395) LAGGLGSLSGIRYGLTRVDFDMIFRNHPDIVTGLFYHPGHAGIATQVKDS 451                                                500
  Cry1Bd (451) ETELPPETTERPNYESYSHRLSHIGLIIGNTLRAPVYSWTHRSADRTNTI
 IP1B-B1  (445) ETELPPETTERPNYESYSHRLSHIGLIIGNTLRAPVYSWTHRSADRTNTI
   MP258  (449) ETELPPETTERPNYESYSHRLSNIRLISGNTLRAPVYSWTHRSADRTNTI
 IP1B-B21 (449) ETELPPETTERPNYESYSHRLSNIRLIIGNTLRAPVYSWTHRSADRTNTI
 IP1B-B22 (449) ETELPPETTERPNYESYSHRLSHIGLIIGNTLRAPVYSWTHRSADRTNTT
 IP1B-B23 (444) ETELPPETTERPNYESYSHRLSNIRLISGNTLRAPVYSWTHRSADRTNTI
 IP1B-B24 (449) ETELPPETTERPNYESYSHRLSNIRLIIGNTLRAPVYSWTHRSADRTNTI
 IP1B-B25 (449) ETELPPETTERPNYESYSHRLSNIRLIIGNTLRAPVYSWTHRSADRTNTI
 IP1B-B26 (449) ETELPPETTERPNYESYSHRLSNIRLIISNTLRAPVYSWTHRSADRTNTI
 IP1B-B27 (449) ETELPPETTERPNYESYSHRLSNIRLIISGTLRAPVYSWTHRSADRTNTI
 IP1B-B28 (449) ETELPPETTERPNYESYSHRLSNIRLIIGNTLRAPVYSWTHRSADRTNTI
 IP1B-B29 (449) ETELPPETTERPNYESYSHRLSNIRLIIGNTLRAPVYSWTHRSADRTNTI
 IP1B-B40 (449) ETELPPETTERPNYESYSHRLSNIRLIISNTLRAPVYSWTHRSADRTNTI
 IP1B-B41 (449) ETELPPETTERPNYESYSHRLSNIRLIIGNTLRAPVYSWTHRSADRTNTI
 IP1B-B42 (449) ETELPPETTERPNYESYSHRLSNIRLIIGGTLRAPVYSWTHRSADRTNTI
 IP1B-B43 (449) ETELPPETTERPNYESYSHRLSNIRLIIGGTLRAPVYSWTHRSADRTNTI
 IP1B-B44 (449) ETELPPETTERPNYESYSHRLSNIRLIIGGTLRAPVYSWTHRSADRTNTI
 IP1B-B45 (449) ETELPPETTERPNYESYSHRLSNIRLIIGGTLRAPVYSWTHRSADRTNTI
 IP1B-B46 (449) ETELPPETTERPNYESYSHRLSNIRLIIGNTLRAPVYSWTHRSADRTNTI
 IP1B-B47 (449) ETELPPETTERPNYESYSHRLSNIRLIIGNTLRAPVYSWTHRSADRTNTI
 IP1B-B31 (446) ETELPPETTERPNYESYSHRLSHIGLIIGNTLRAPVYSWTHRSATITNTI
 IP1B-B32 (446) ETELPPETTERPNYESYSHRLSHIGLIIGNTLRAPVYSWTHRSATITNTI
 IP1B-B33 (446) ETELPPETTERPNYESYSHRLSHIGLIIGNTLRAPVYSWTHRSATITNTI
 IP1B-B34 (446) ETELPPETTERPNYESYSHRLSHIGLIIGNTLRAPVYSWTHRSATITNTI
   GS060  (445) ETELPPETTEQPNYRAFSHLLSHISMGPTTQDVPPVYSWTHQSADRTNTI
```

Fig. 1F

```
                    501                                                      550
    Cry1Bd  (501)   GPNRITQIPAVKGRFLFNG-SVISGPGFTGGDVVRLNRNNGNIQNRGYIE
    IP1B-B1 (495)   GPNRITQIPAVKGRFLFNG-SVISGPGFTGGDVVRLNRNNGNIQNRGYIE
     MP258  (499)   ATNIITQIPAVKGNFLFNG-SVISGPGFTGGDLVRLNNSGNNIQNRGYLE
   IP1B-B21 (499)   ATNIITQIPAVKGNFLFNG-SVISGPGFTGGDLVRLNNSGNNIQNRGYIE
   IP1B-B22 (499)   GPNRITQIPAVKGNFLFNG-SVISGPGFTGGDLVRLNNSGNNIQNRGYLE
   IP1B-B23 (494)   ATNIITQIPAVKGNFLFNG-SVTSGPGFTGGDLVRLNNSGNNIQNRGYLE
   IP1B-B24 (499)   ATNIITQIPAVKGNFLFNG-SVISGPGFTGGDLVRLNNSGNNIQNRGYIE
   IP1B-B25 (499)   ATNIITQIPAVKGNFLFNG-SVISGPGFTGGDLVRLNNSGNNIQNRGYIE
   IP1B-B26 (499)   ATNIITQIPAVKGNFLFNG-SVISGPGFTGGDLVRLNNSGNNIQNRGYIE
   IP1B-B27 (499)   ATNIITQIPAVKGNFLFNG-SVISGPGFTGGDLVRLNNSGNNIQNRGYIE
   IP1B-B28 (499)   ATNIITQIPAVKGNFLFNG-SVISGPGFTGGDLVRLNNSGNNIQNRGYIE
   IP1B-B29 (499)   ATNIITQIPAVKGNFLFNG-SVISGPGFTGGDLVRLNNSGNNIQNRGYIE
   IP1B-B40 (499)   ATNIITQIPAVKGNFLFNG-SVISGPGFTGGDLVRLNNSGNNIYNRGYIE
   IP1B-B41 (499)   ATNIITQIPAVKGNFLFNG-SVISGPGFTGGDLVRLNNSGNNIYNRGYIE
   IP1B-B42 (499)   ATNIITQIPAVKGNFLFNG-SVISGPGFTGGDLVRLNNSGNNIQNRGYIE
   IP1B-B43 (499)   ATNIITQIPAVKGNFLFNG-SVISGPGFTGGDLVRLNNSGNNIQNRGYIE
   IP1B-B44 (499)   ATNIITQIPAVKGNFLFNG-SVISGPGFTGGDLVRLNNSGNNIQNRGYIE
   IP1B-B45 (499)   ATNIITQIPAVKGNFLFNG-SVISGPGFTGGDLVRLNNSGNNIQNRGYIE
   IP1B-B46 (499)   ATNIITQIPAVKGNFLFNG-SVISGPGFTGGDLVRLNNSGNNIQNRGYIE
   IP1B-B47 (499)   ATNIITQIPAVKGNFLFNG-SVISGPGFTGGDLVRLNNSGNNIQNRGYIE
   IP1B-B31 (496)   DPERINQIPLVKGFRVWGGTSVITGPGFTGGDILRRNTFGDFVSLQVNIN
   IP1B-B32 (496)   DPERINQIPLVKGFRVWGGTSVITGPGFTGGDILRRNTFGDFVSLQVNIN
   IP1B-B33 (496)   DPERINQIPLVKGFRVWGGTSVITGPGFTGGDILRRNTFGDFVSLQVNIN
   IP1B-B34 (496)   DPERINQIPLVKGFRVWGGTSVITGPGFTGGDILRRNTFGDFVSLQVNIN
     GS060  (495)   NSDRITQIPLVKAHTLQSGTTVVKGPGFTGGDILRRTSGGPFAFSNVNLD 551                                                      600
    Cry1Bd  (550)   VPIQFTSTSTRYRVRVRYASVTSIELNVNLGNSS-------IFTNTLPAT
    IP1B-B1 (544)   VPIQFTSTSTRYRVRVRYASVTSIELNVNLGNSS-------IFTNTLPAT
     MP258  (548)   VPIQFISTSTRYRVRVRYASVTPIQLSVNWGNSN-------IFSSIVPAT
   IP1B-B21 (548)   VPIQFISTSTRYRVRVRYASVTPIQLSVNWGNSN-------IFSSIVPAT
   IP1B-B22 (548)   VPIQFISTSTRYRVRVRYASVTPIQLSVNWGNSN-------IFSSIVPAT
   IP1B-B23 (543)   VPIQFISTSTRYRVRVRYASVTPIQLSVNWGNSN-------IFSSIVPAT
   IP1B-B24 (548)   VPIQFISTSTRYRVRVRYASVTPIQLSVNWGNSN-------IFSRIVPAT
   IP1B-B25 (548)   VPIQFISTSTRYRVRVRYASVTPIRLSVNWGNSN-------IFSSIVPAT
   IP1B-B26 (548)   VPIQFISTSTRYRVRVRYASVTPIRLSVNWGNSN-------IFSSIVPAT
   IP1B-B27 (548)   VPIQFISTSTRYRVRVRYASVTPIRLSVNWGNSN-------IFSSIVPAT
   IP1B-B28 (548)   VPIQFISTSTRYRVRVRYASVTPIRLSVNWGNSN-------IFSSIVPAT
   IP1B-B29 (548)   VPIQFISTSTRYRVRVRYASVTPIRLSVNWGNSN-------IFSSIVPAT
   IP1B-B40 (548)   VPIQFISTSTRYRVRVRYASVTPIRLSVNWGNSN-------IFSSIVPAT
   IP1B-B41 (548)   VPIQFISTSTRYRVRVRYASVTPIRLSVNWGNSN-------IFSTIVPAT
   IP1B-B42 (548)   VPIQFISTSTRYRVRVRYASVTPIRLSVNWGNSN-------IFSSIVPAT
   IP1B-B43 (548)   VPIQFISTSTRYRVRVRYASVTPIRLSVNWGNSN-------IFSSIVPAT
   IP1B-B44 (548)   VPIQFISTSTRYRVRVRYASVTPIRLSVNWGNSN-------IFSSIVPAT
   IP1B-B45 (548)   VPIQFISTSTRYRVRVRYASVTPIRLSVNWGNSN-------IFSSIVPAT
   IP1B-B46 (548)   VPIQFISTSTRYRVRVRYASVTPIRLSVNWGNSN-------IFSSIVPAT
   IP1B-B47 (548)   VPIQFISTSTRYRVRVRYASVTPIRLSVNWGNSN-------IFSSIVPAT
   IP1B-B31 (546)   SPIT------QRYRLRFRYASSRDARVIVLTGAASTGVGGQVSVNMPIQKT
   IP1B-B32 (546)   SPIT------QRYRLRFRYASSRDARVIVLTGAASTGVGGQVSVNMPIQKT
   IP1B-B33 (546)   SPIT------QRYRLRFRYASSRDARVIVLTGAASTGVGGQVSVNMPIQKT
   IP1B-B34 (546)   SPIT------QRYRLRFRYASSRDARVIVLTGAASTGVGGQVSVNMPIQKT
     GS060  (545)   FNIS------QRYRARIRYASTTNLRIYVTVAGER-------IFAGQFDKT
```

Fig. 1G

```
              601                                                   650
   Cry1Bd (593) AASLDNLQSGDFGYVEINNAFTS---ATGNIVGARN-------FSANAEV
   IP1B-B1 (587) AASLDNLQSGDFGYVEINNAFTS---ATGNIVGARN-------FSANAEV
    MP258 (591) ATSLDNLQSRDFGYFESTNAFTS---ATGNVVGVRN-------FSENAGV
  IP1B-B21 (591) ATSLDNLQSRNFGYFESTNAFTS---ATGNVVGVRN-------FSENAGV
  IP1B-B22 (591) ATSLDNLQSRDFGYFESTNAFTS---ATGNVVGVRN-------FSENAGV
  IP1B-B23 (586) ATSLDNLQSRDFGYFESTNAFTS---ATGNVVGVRN-------FSENAGV
  IP1B-B24 (591) AYSLDNLQSRNFGYFESTNAFTS---ATGNVVGVRN-------FSENAGV
  IP1B-B25 (591) ATSLDNLQSRNFGYFESRNAFTS---ATGNVVGVRN-------FSENAGV
  IP1B-B26 (591) ATSLDNLQSRNFGYFESRNAFTS---ATGNVVGVRN-------FSENAGV
  IP1B-B27 (591) ATSLDNLQSRNFGYFESRNAFTS---ATGNVVGVRN-------FSENAGV
  IP1B-B28 (591) ATSLDNLQSRNFGYFESRNAFTS---ATGNVVGVRN-------FSENAGV
  IP1B-B29 (591) ATSLDNLQSRNFGYFESRNAFTS---ATGNVVGVRN-------FSENAGV
  IP1B-B40 (591) ATSLDNLQSRNFGYFESRNAFTS---ATGNVVGVRN-------FSENAGV
  IP1B-B41 (591) ATSLDNLQSRNFGYFESRNAFTS---ATGNVVGVRN-------FSENAGV
  IP1B-B42 (591) ATSLDNLQSRNFGYFESRNAFTS---ATGNVVGVRN-------FSENAGV
  IP1B-B43 (591) ATSLDNLQSRNFGYFESRNAFTS---ATGNVVGVRN-------FSENAGV
  IP1B-B44 (591) ATSLDNLQSRNFGYFESRNAFTS---ATGNVVGVRN-------FSENAGV
  IP1B-B45 (591) ATSLDNLQSRNFGYFESRNAFTS---ATGNVVGVRN-------FSENAGV
  IP1B-B46 (591) ATSLDNLQSRNFGYFESRNAFTS---ATGNVVGVRN-------FSENAGV
  IP1B-B47 (591) ATSLDNLQSRNFGYFESRNAFTS---ATGNVVGVRN-------FSENAGV
  IP1B-B31 (591) MEIGENLTSRTFRYTDFSNPFSFR--ANPDIIGISEQPLFGAGSISSGEL
  IP1B-B32 (591) MEIGENLTSRTFRYTDFSNPFSFR--ANPDIIGISEQPLFGAGSISSGEL
  IP1B-B33 (591) MEIGENLTSRTFRYTDFSNPFSFR--ANPDIIGISEQPLFGAGSISSGEL
  IP1B-B34 (591) MEIGENLTSRTFRYTDFSNPFSFR--ANPDIIGISEQPLFGAGSISSGEL
    GS060 (583) MDAGAPLTFQSFSYATINTAFTFPERSSSLTVGADT-------FSSGNEV 651           675
   Cry1Bd (633) IIDRFEFIPVTATFEAEYDLERAQK
   IP1B-B1 (627) IIDRFEFIPVTATFEAEYDLERAQK
    MP258 (631) IIDRFEFIPVTATFEAEYDLERAQE
  IP1B-B21 (631) IIDRFEFIPVTATFEAEYDLERAQE
  IP1B-B22 (631) IIDRFEFIPVTATFEAEYDLERAQE
  IP1B-B23 (626) IIDRFEFIPVTATFEAEYDLERAQE
  IP1B-B24 (631) IIDRFEFIPVTATFEAEYDLERAQE
  IP1B-B25 (631) IIDRFEFIPVTATFEAEYDLERAQE
  IP1B-B26 (631) IIDRFEFIPVTATFEAEYDLERAQE
  IP1B-B27 (631) IIDRFEFIPVTATFEAEYDLERAQE
  IP1B-B28 (631) IIDRFEFIPVTATFEAEYDLERAQE
  IP1B-B29 (631) IIDRFEFIPVTATFEAEYDLERAQE
  IP1B-B40 (631) IIDRFEFIPVTATFEAEYDLERAQE
  IP1B-B41 (631) IIDRFEFIPVTATFEAEYDLERAQE
  IP1B-B42 (631) IIDRFEFIPVTATFEAEYDLERAQE
  IP1B-B43 (631) IIDRFEFIPVTATFEAEYDLERAQE
  IP1B-B44 (631) IIDRFEFIPVTATFEAEYDLERAQE
  IP1B-B45 (631) IIDRFEFIPVTATFEAEYDLERAQE
  IP1B-B46 (631) IIDRFEFIPVTATFEAEYDLERAQE
  IP1B-B47 (631) IIDRFEFIPVTATFEAEYDLERAQE
  IP1B-B31 (639) YIDKIEIILADATFEAESDLERAQK
  IP1B-B32 (639) YIDKIEIILADATFEAESDLEGARK
  IP1B-B33 (639) YIDKIEIILADATFEAESDLEKAQK
  IP1B-B34 (639) YIDKIEIILADATFEAESDLERAQK
    GS060 (626) YVDRFELIPVTATFEAESDLERARK
```

Fig. 2A

```
Met Thr Ser Asn Arg Lys Asn Glu Asn Glu Ile Ile Asn Ala Leu Ser
1               5                   10                  15
****************************************************************

Ile Pro Ala Val Ser Asn His Ser Ala Gln Met Asp Leu Ser Pro Asp
                20                  25                  30
****************************************************************

Ala Arg Ile Glu Asp Ser Leu Cys Ile Ala Glu Gly Asn Asn Ile Asn
            35                  40                  45
*******#########################################################

Pro Leu Val Ser Ala Ser Thr Val Gln Thr Gly Ile Asn Ile Ala Gly
        50                  55                  60
################################################################

Arg Ile Leu Gly Val Leu Gly Val Pro Phe Ala Gly Gln Leu Ala Ser
65                  70                  75                  80
################################################################

Phe Tyr Ser Phe Ile Val Gly Glu Leu Trp Pro Ser Gly Arg Asp Pro
                85                  90                  95
################################################################

Trp Glu Ile Phe Leu Glu His Val Gln Leu Val Arg Gln Gln Ile
                100                 105                 110
################################################################

Thr Glu Asn Ala Arg Asn Thr Ala Leu Ala Arg Leu Gln Gly Leu Gly
            115                 120                 125
################################################################

Ala Ser Phe Arg Ala Tyr Gln Ser Leu Glu Asp Trp Leu Glu Asn
        130                 135                 140
################################################################
```

Fig. 2B

```
Arg Asp Asp Ala Arg Thr Arg Ser Val Leu Tyr Thr Gln Tyr Ile Ala
145             150                 155                 160
################################################################

Leu Glu Leu Asp Phe Leu Asn Ala Met Pro Leu Phe Ala Ile Asn Asn
                165                 170                 175
################################################################

Gln Gln Val Pro Leu Leu Met Val Tyr Ala Gln Ala Ala Asn Leu His
                180                 185                 190
################################################################

Leu Leu Leu Leu Arg Asp Ala Ser Leu Phe Gly Ser Glu Phe Gly Leu
            195                 200                 205
################################################################

Thr Ser Gln Glu Ile Gln Arg Tyr Tyr Glu Arg Gln Ala Glu Lys Thr
        210                 215                 220
################################################################

Arg Glu Tyr Ser Asp Tyr Cys Ala Arg Trp Tyr Asn Thr Gly Leu Asn
225             230                 235                 240
################################################################

Asn Leu Arg Gly Thr Asn Ala Glu Ser Trp Leu Arg Tyr Asn Gln Phe
                245                 250                 255
################################################################

Arg Arg Asp Leu Thr Leu Gly Val Leu Asp Leu Val Ala Leu Phe Pro
                260                 265                 270
################################################################

Ser Tyr Asp Thr Arg Ile Tyr Pro Ile Asn Thr Ser Ala Gln Leu Thr
            275                 280                 285
################&&&&&&&&&&&&&&&&&&&&&&&&&&&&&&&&&&&&&&&&&&&&&&&&
```

Fig. 2C

```
Arg Glu Ile Tyr Thr Asp Pro Ile Gly Arg Thr Asn Ala Pro Ser Gly
    290                 295                 300
&&&&&&&&&&&&&&&&&&&&&&&&&&&&&&&&&&&&&&&&&&&&&&&&&&&&&&&&&&&&&&&&

Phe Ala Ser Thr Asn Trp Phe Asn Asn Asn Ala Pro Ser Phe Ser Ala
305                 310                 315                 320
&&&&&&&&&&&&&&&&&&&&&&&&&&&&&&&&&&&&&&&&&&&&&&&&&&&&&&&&&&&&&&&&

Ile Glu Ala Ala Val Ile Arg Pro Pro His Leu Leu Asp Phe Pro Glu
                325                 330                 335
&&&&&&&&&&&&&&&&&&&&&&&&&&&&&&&&&&&&&&&&&&&&&&&&&&&&&&&&&&&&&&&&

Gln Leu Thr Ile Phe Ser Val Leu Ser Arg Trp Ser Asn Thr Gln Tyr
            340                 345                 350
&&&&&&&&&&&&&&&&&&&&&&&&&&&&&&&&&&&&&&&&&&&&&&&&&&&&&&&&&&&&&&&&

Met Asn Tyr Trp Val Gly His Arg Leu Glu Ser Arg Thr Ile Arg Gly
        355                 360                 365
&&&&&&&&&&&&&&&&&&&&&&&&&&&&&&&&&&&&&&&&&&&&&&&&&&&&&&&&&&&&&&&&

Ser Leu Ser Thr Ser Thr His Gly Asn Thr Asn Thr Ser Ile Asn Pro
    370                 375                 380
&&&&&&&&&&&&&&&&&&&&&&&&&&&&&&&&&&&&&&&&&&&&&&&&&&&&&&&&&&&&&&&&

Val Thr Leu Gln Phe Thr Ser Arg Asp Val Tyr Arg Thr Glu Ser Tyr
385                 390                 395                 400
&&&&&&&&&&&&&&&&&&&&&&&&&&&&&&&&&&&&&&&&&&&&&&&&&&&&&&&&&&&&&&&&

Ala Gly Ile Asn Ile Leu Leu Thr Thr Pro Val Asn Gly Val Pro Trp
                405                 410                 415
&&&&&&&&&&&&&&&&&&&&&&&&&&&&&&&&&&&&&&&&&&&&&&&&&&&&&&&&&&&&&&&&

Ala Arg Phe Asn Trp Arg Asn Pro Leu Asn Ser Leu Arg Gly Ser Leu
            420                 425                 430
&&&&&&&&&&&&&&&&&&&&&&&&&&&&&&&&&&&&&&&&&&&&&&&&&&&&&&&&&&&&&&&&
```

Fig. 2D

Leu Tyr Thr Ile Gly Tyr Thr Gly Val Gly Thr Gln Leu Phe Asp Ser
      435                440               445
&&&&&&&&&&&&&&&&&&&&&&&&&&&&&&&&&&&&&&&&&&&&&&&&&

Glu Thr Glu Leu Pro Pro Glu Thr Thr Glu Arg Pro Asn Tyr Glu Ser
      450                455               460
&&&&&&&&&&&&&&&&&&&&&&&&&&&&&&&&&&&&&&&&&&&&&&&&&

Tyr Ser His Arg Leu Ser Asn Ile Arg Leu Ile Ser Gly Asn Thr Leu
465                470               475              480
&&&&&&&&&&&&&&&&&&&&&&&&&&&&&&&&&&&&&&&&&&&&&&&&&

Arg Ala Pro Val Tyr Ser Trp Thr His Arg Ser Ala Asp Arg Thr Asn
      485                490               495
&&&&&&&&&&&&&&&&&&&&&&&&&&&&&&&&&&&&&&!!!!!!!!!!!

Thr Ile Ala Thr Asn Ile Ile Thr Gln Ile Pro Ala Val Lys Gly Asn
      500                505               510
!!!!!!!!!!!!!!!!!!!!!!!!!!!!!!!!!!!!!!!!!!!!!!!!!

Phe Leu Phe Asn Gly Ser Val Ile Ser Gly Pro Gly Phe Thr Gly Gly
      515                520               525
!!!!!!!!!!!!!!!!!!!!!!!!!!!!!!!!!!!!!!!!!!!!!!!!!

Asp Leu Val Arg Leu Asn Asn Ser Gly Asn Asn Ile Gln Asn Arg Gly
      530                535               540
!!!!!!!!!!!!!!!!!!!!!!!!!!!!!!!!!!!!!!!!!!!!!!!!!

Tyr Leu Glu Val Pro Ile Gln Phe Ile Ser Thr Ser Thr Arg Tyr Arg
545                550               555              560
!!!!!!!!!!!!!!!!!!!!!!!!!!!!!!!!!!!!!!!!!!!!!!!!!

Val Arg Val Arg Tyr Ala Ser Val Thr Pro Ile Gln Leu Ser Val Asn
      565                570               575
!!!!!!!!!!!!!!!!!!!!!!!!!!!!!!!!!!!!!!!!!!!!!!!!!

Fig. 2E

Trp Gly Asn Ser Asn Ile Phe Ser Ser Ile Val Pro Ala Thr Ala Thr
          580                 585                 590
!!!!!!!!!!!!!!!!!!!!!!!!!!!!!!!!!!!!!!!!!!!!!!!!!

Ser Leu Asp Asn Leu Gln Ser Arg Asp Phe Gly Tyr Phe Glu Ser Thr
          595                 600                 605
!!!!!!!!!!!!!!!!!!!!!!!!!!!!!!!!!!!!!!!!!!!!!!!!!

Asn Ala Phe Thr Ser Ala Thr Gly Asn Val Val Gly Val Arg Asn Phe
          610                 615                 620
!!!!!!!!!!!!!!!!!!!!!!!!!!!!!!!!!!!!!!!!!!!!!!!!!

Ser Glu Asn Ala Gly Val Ile Ile Asp Arg Phe Glu Phe Ile Pro Val
625                 630                 635                 640
!!!!!!!!!!!!!!!!!!!!!!!!!!!!!!!!!!!!!!!!!!!!!!!!!

Thr Ala Thr Phe Glu Ala Glu Tyr Asp Leu Glu Arg Ala Gln Glu
                 645                 650                 655
!!!!!!!!!!!!!!!!!!!!!!!!!!!!!!!!!!!!!!!!!!!!!!!!!

Fig. 3

```
                        1                                                  50
Cry1Be Dom I    (1)  IEDSLCIAEGNNIDPFVSASTVQTGINIAGRILGVLGVPFAGQIASFYSF
 MP258 Dom I    (1)  IEDSLCIAEGNNINPLVSASTVQTGINIAGRILGVLGVPFAGQLASFYSF 51                                                100
Cry1Be Dom I   (51)  LVGELWPRGRDPWEIFLEHVEQLIRQQVTENTRDTALARLQGLGNSFRAY
 MP258 Dom I   (51)  IVGELWPSGRDPWEIFLEHVEQLVRQQITENARNTALARLQGLGASFRAY 101                                               150
Cry1Be Dom I  (101)  QQSLEDWLENRDDARTRSVLYTQYIALELDFLNAMPLFAIRNQEVPLLMV
 MP258 Dom I  (101)  QQSLEDWLENRDDARTRSVLYTQYIALELDFLNAMPLFAINNQQVPLLMV 151                                               200
Cry1Be Dom I  (151)  YAQAANLHLLLLRDASLFGSEFGLTSQEIQRYYERQVEKTREYSDYCARW
 MP258 Dom I  (151)  YAQAANLHLLLLRDASLFGSEFGLTSQEIQRYYERQAEKTREYSDYCARW

201
Cry1Be Dom I  (201)  YNTGLNNLRGTNAESWLRYNQFRRDLTLGVLDLVALFPSYD
 MP258 Dom I  (201)  YNTGLNNLRGTNAESWLRYNQFRRDLTLGVLDLVALFPSYD
                        251
```

Fig. 4

```
              1                                                  50
Cry1Ah D3  (1)  --NNIIASDSITQIPAVKGNFLFNGSVISGPGFTGGDLVRLNSSGNNIQNR
Cry1Bd D3  (1)  RTNTIGPNRITQIPAVKGRFLFNGSVISGPGFTGGDVVRLNRNNGNIQNR
Cry1Bh D3  (1)  RTNTIGPNRITQIPAVKGRFLFNGSVISGPGFTGGDVVRLNRNNGNIQNR
Cry1Bi D3  (1)  RTNTIGPNRITQIPAVKGNLLFNGSVISGPGFTGGDLVRLNNSGNNIQNR
 MP258 D3  (1)  RTNTIATNIITQIPAVKGNFLFNGSVISGPGFTGGDLVRLNNSGNNIQNR 51                                                 100
Cry1Ah D3 (50)  GYIEVPIHFPSTSTRYRVRVRYASVTPIHLNVNWGNSSIFSNTVPATATS
Cry1Bd D3 (51)  GYIEVPIQFTSTSTRYRVRVRYASVTSIELNVNLGNSSIFTNTLPATAAS
Cry1Bh D3 (51)  GYIEVPIQFTSTSTRYRVRVRYASVTSIELNVNWGNSSIFTNTLPATAAS
Cry1Bi D3 (51)  GYLEVPIQFTSTSTRYRVRVRYASVTPIHLSVNWGNSNIFSSTVPATAAS
 MP258 D3 (51)  GYLEVPIQFISTSTRYRVRVRYASVTPIQLSVNWGNSNIFSSIVPATATS 101                                                150
Cry1Ah D3 (100) LDNLQSSDFGYFESANAFTSSLGNIVGVRNFSGTAGVIIDRFEFIPVTAT
Cry1Bd D3 (101) LDNLQSGDFGYVEINNAFTSATGNIVGARNFSANAEVIIDRFEFIPVTAT
Cry1Bh D3 (101) LDNLQSGDFGYVEINNAFTSATGNIVGVRNFSANAEVIIDRFEFIPVTAT
Cry1Bi D3 (101) LDNLQSRDFGYFESTNAFTSVTGNVVGVRNFSENARVIIDRFEFIPVTAT
 MP258 D3 (101) LDNLQSRDFGYFESTNAFTSATGNVVGVRNFSENAGVIIDRFEFIPVTAT 151      162
Cry1Ah D3 (150) LEAEYNLERAQK
Cry1Bd D3 (151) FEAEYDLERAQK
Cry1Bh D3 (151) FEAKYDLERAQK
Cry1Bi D3 (151) FEAEYDLERAQE
 MP258 D3 (151) FEAEYDLERAQE
```

Fig. 5A

```
                          1                                                  50
MP258  D1&2       (1)    IEDSLCIAEGNNINPLVSASTVQTGINIAGRILGVLGVPFAGQLASFYSF
Cry1Be D1&2       (1)    IEDSLCIAEGNNIDPFVSASTVQTGINIAGRILGVLGVPFAGQLASFYSF
Cry1Bi D1&2       (1)    IEDGLCIAEGEYIDPFVSASTVQTGISIAGRILGVLGVPFAGQLASFYSF
Cry1Bg D1&2       (1)    IEDGLCIAEGEYIDPFVSASTVQTGISIAGRILGVLGVPFAGQLASFYSF
Cry1Bf D1&2       (1)    IEDSLCIAEGNNINPLVSASTVQTGINIAGRILGVLGVPFAGQIASFYSF
Cry1Ba D1&2       (1)    IEDSLCIAEGNNIDPFVSASTVQTGINIAGRILGVLGVPFAGQLASFYSF
Cry1Bh D1&2       (1)    IEDSLCVAEVNNIDPFVSASTVQTGINIAGRILGVLGVPFAGQLASFYSF
Cry1Bd D1&2       (1)    IEDSLCIAEGNNINPLVSASTVQTGINIAGRILGVLGVPFAGQLASFYSF
Cry1Bb D1&2       (1)    IEDSLCVAEVNNIDPFVSASTVQTGINIAGRILGVLGVPFAGQLASFYSF
Cry1Bc D1&2       (1)    IEDSLCVAEVNNIDPFVSASTVQTGINIAGRILGVLGVPFAGQLASFYSF 51                                                 100
MP258  D1&2      (51)    IVGELWPSGRDPWEIFLEHVEQLVRQQITENARNTALARLQGLGASFRAY
Cry1Be D1&2      (51)    LVGELWPRGRDPWEIFLEHVEQLIRQQVTENTRDTALARLQGLGNSFRAY
Cry1Bi D1&2      (51)    IVGELWPKGRDQWEIFMEHVEQLVRQQITANARNTALARLQGLGDSFRAY
Cry1Bg D1&2      (51)    IVGELWPKGRDQWEIFMEHVEQLVRQQITANARNTALARLQGLGDSFRAY
Cry1Bf D1&2      (51)    LVGELWPRGRDQWEIFLEHVEQLINQQITENARNTALARLQGLGDSFRAY
Cry1Ba D1&2      (51)    LVGELWPRGRDQWEIFLEHVEQLINQQITENARNTALARLQGLGDSFRAY
Cry1Bh D1&2      (51)    LVGELWPSGRDPWEIFLEHVEQLIRQQVTENTRNTAIARLEGLGRGYRSY
Cry1Bd D1&2      (51)    LVGELWPSGRDPWEIFLEHVEQLIRQQVTENTRNTAIARLEGLGRGYRSY
Cry1Bb D1&2      (51)    LVGELWPSGRDPWEIFLEHVEQLIRQQVTENTRNTAIARLEGLGRGYRSY
Cry1Bc D1&2      (51)    LVGELWPSGRDPWEIFLEHVEQLIRQQVTENTRNTAIARLEGLGRGYRSY 101                                                150
MP258  D1&2     (101)    QQSLEDWLENRDDARTRSVLYTQYIALELDFLNAMPLFAINNQQVPLLMV
Cry1Be D1&2     (101)    QQSLEDWLENRDDARTRSVLYTQYIALELDFLNAMPLFAIRNQEVPLLMV
Cry1Bi D1&2     (101)    QQSLEDWLENRNDARTRSVLYTQYIALELDFLNAMPLFAIREQEVPLLMV
Cry1Bg D1&2     (101)    QQSLEDWLENRNDARTRSVLYTQYIALELDFLNAMPLFAIREQEVPLLMV
Cry1Bf D1&2     (101)    QQSLEDWLENRDDARTRSVLYTQYIALELDFLNAMPLFAIRNQEVPLLMV
Cry1Ba D1&2     (101)    QQSLEDWLENRDDARTRSVLYTQYIALELDFLNAMPLFAIRNQEVPLLMV
Cry1Bh D1&2     (101)    QQALETWLDNRNDARSRSIILERYVALELDITTAIPLFRIRNQEVPLLMV
Cry1Bd D1&2     (101)    QQALETWLDNRNDARSRSIILERYVALELDITTAIPLFRIRNEEVPLLMV
Cry1Bb D1&2     (101)    QQALETWLDNRNDARSRSIILERYVALELDITTAIPLFRIRNEEVPLLMV
Cry1Bc D1&2     (101)    QQALETWLDNRNDARSRSIILERYVALELDITTAIPLFRIRNEEVPLLMV 151                                                200
MP258  D1&2     (151)    YAQAANLHLLLLRDASLFGSEFGLTSQEIQRYYERQAEKTREYSDYCARW
Cry1Be D1&2     (151)    YAQAANLHLLLLRDASLFGSEFGLTSQEIQRYYERQVEKTREYSDYCARW
Cry1Bi D1&2     (151)    YAQAANLHLLLLRDASLYGREFGLTSQEIQRYYERQVERTRDYSDHCVQW
Cry1Bg D1&2     (151)    YAQAANLHLLLLRDASLYGREFGLTSQEIQRYYERQVERTRDYSDHCVQW
Cry1Bf D1&2     (151)    YAQAANLHLLLLRDASLFGSEFGLTSQEIQRYYERQVEQTRDYSDYCVEW
Cry1Ba D1&2     (151)    YAQAANLHLLLLRDASLFGSEFGLTSQEIQRYYERQVERTRDYSDYCVEW
Cry1Bh D1&2     (151)    YAQAANLHLLLLRDASLFGSEWGTASSDVNQYYQEQIRYTEEYSNHCVQW
Cry1Bd D1&2     (151)    YAQAANLHLLLLRDASLFGSEWGMASSDVNQYYQEQIRYTEEYSNHCVQW
Cry1Bb D1&2     (151)    YAQAANLHLLLLRDASLFGSEWGMASSDVNQYYQEQIRYTEEYSNHCVQW
Cry1Bc D1&2     (151)    YAQAANLHLLLLRDASLFGSEWGMASSDVNQYYQEQIRYTEEYSNHCVQW
```

Fig. 5B

```
                    201                                                  250
MP258  D1&2  (201)  YNTGLNNLRGTNAESWLRYNQFRRDLTGVLDLVALFPSYDTRIYPINTS
CrylBe D1&2  (201)  YNTGLNNLRGTNAESWLRYNQFRRDLTGVLDLVALFPSYDTRVYPMNTS
CrylBi D1&2  (201)  YNTGLNNLRGTNAESWVRYNQFRRDLTGVLDLVALFPSYDTRTYPINTS
CrylBg D1&2  (201)  YNTGLNNLRGTNAESWVRYNQFRRDLTGVLDLVALFPSYDTRTYPINTS
CrylBf D1&2  (201)  YNTGLNSLRGTNAASWVRYNQFRRDLTGVLDLVALFPSYDTRTYPINTS
CrylBa D1&2  (201)  YNTGLNSLRGTNAASWVRYNQFRRDLTGVLDLVALFPSYDTRTYPINTS
CrylBh D1&2  (201)  YNTGLNNLRGTNAESWVRYNQFRRDLTGVLDLVALFPSYDTRTYPINTS
CrylBd D1&2  (201)  YNTGLNNLRGTNAESWLRYNQFRRDLTGVLDLVALFPSYDTRTYPINTS
CrylBb D1&2  (201)  YNTGLNNLRGTNAESWLRYNQFRRDLTGVLDLVALFPSYDTRTYPINTS
CrylBc D1&2  (201)  YNTGLNNLRGTNAESWLRYNQFRRDLTGVLDLVALFPSYDTRTYPINTS 251                                                  300
MP258  D1&2  (251)  AQLTREIYTDPIGRTNAPSGFASTNWFNNNAPSFSAIEAAVIRPPHLLDF
CrylBe D1&2  (251)  AQLTREIYTDPIGRTNAPSGFASTNWFNNNAPSFSAIEAAVIRPPHLLDF
CrylBi D1&2  (251)  AQLTREVYTDAIGATGVN--MASMNWYNNNAPSFSAIETAVIRSPHLLDF
CrylBg D1&2  (251)  AQLTREVYTDAIGATGVN--MASMNWYNNNAPSFSAIETAVIRSPHLLDF
CrylBf D1&2  (251)  AQLTREVYTDAIGATGVN--MASMNWYNNNAPSFSAIETAVIRSPHLLDF
CrylBa D1&2  (251)  AQLTREVYTDAIGATGVN--MASMNWYNNNAPSFSAIEAAAIRSPHLLDF
CrylBh D1&2  (251)  AQLTREVYTDAIGTVHPSQAFASTTWFNNNAPSFSAIEAAVIRPPHLLDF
CrylBd D1&2  (251)  AQLTREIYTDPIGRTNAPSGFASTNWFNNNAPSFSAIEAAIFRPPHLLDF
CrylBb D1&2  (251)  AQLTREIYTDPIGRTNAPSGFASTNWFNNNAPSFSAIEAAIFRPPHLLDF
CrylBc D1&2  (251)  AQLTREIYTDPIGRTNAPSGFASTNWFNNNAPSFSAIEAAIFRPPHLLDF 301                                                  350
MP258  D1&2  (301)  PEQLTIFSVLSRWSNTQYMNYWVGHRLESRTIRGSLSTSTHGNTN-TSIN
CrylBe D1&2  (301)  PEQLTIFSVLSRWSNTQYMNYWVGHRLESRTIRGSLSTSTHGNTN-TSIN
CrylBi D1&2  (299)  LEQLKIFSASSRWSNTRHMTYWRGHTIQSRPIRGALITSTHGNTN-TSIN
CrylBg D1&2  (299)  LEQLKIFSASSRWSNTRHMTYWRGHTIQSRPIRGALITSTHGNTN-TSIN
CrylBf D1&2  (299)  LEQLTIFSTSSRWSATRHMTYWRGHTIQSRPIGGGLNTSTHGSTN-TSIN
CrylBa D1&2  (299)  LEQLTIFSASSRWSNTRHMTYWRGHTIQSRPIGGGLNTSTHGATN-TSIN
CrylBh D1&2  (301)  PEQLTIYSTLSRWSNTQFMNIWAGHRLESRPIAGSLNTSTQGSTN-TSIN
CrylBd D1&2  (301)  PEQLTIYSASSRWSSTQHMNYWVGHRLNFRPIGGTLNTSTQGLTNNTSIN
CrylBb D1&2  (301)  PEQLTIYSASSRWSSTQHMNYWVGHRLNFRPIGGTLNTSTQGLTNNTSIN
CrylBc D1&2  (301)  PEQLTIYSASSRWSSTQHMNYWVGHRLNFRPIGGTLNTSTQGLTNNTSIN 351                                                  400
MP258  D1&2  (350)  PVTLQFTSRDVYRTESYAGINIL--LTTPVNGVPWARFNWRNPLNSLR-G
CrylBe D1&2  (350)  PVTLQFTSRDVYRTESFAGINIL--LTTPVNGVPWARFNWRNPLNSLR-G
CrylBi D1&2  (348)  PVTFQFPSRDVYRTESYAGVLLWGIYLEPIHGVPTVRFNFRNPQNTFERG
CrylBg D1&2  (348)  PVTFQFPSRDVYRTESYAGVLLWGIYLEPIHGVPTVRFNFRNPQNTFERG
CrylBf D1&2  (348)  PVRLSFFSRDVYWTESYAGVLLWGIYLEPIHGVPTVRFNFRNPQNTFERG
CrylBa D1&2  (348)  PVTLRFASRDVYRTESYAGVLLWGIYLEPIHGVPTVRFNFTNPQNISDRG
CrylBh D1&2  (350)  PVTLQFTSRDIYRTESLAGLNIF--ITQPVNGVPWVRFNWRNPLNSLR-G
CrylBd D1&2  (351)  PVTLQFTSRDVYRTESNAGTNIL--FTTPVNGVPWARFNFINPQNIYERG
CrylBb D1&2  (351)  PVTLQFTSRDVYRTESNAGTNIL--FTTPVNGVPWARFNFINPQNIYERG
CrylBc D1&2  (351)  PVTLQFTSRDVYRTESNAGTNIL--FTTPVNGVPWARFNFINPQNIYERG
```

Fig. 5C

```
                     401                                                      450
MP258  D1&2  (397)  SLLYTIGYTGVGTQLFDSETELPPETTERPNYESYSHRLSNIRLISGNTL
Cry1Be D1&2  (397)  SLLYTIGYTGVGTQLFDSETELPPETTERPNYESYSHRLSNIRLISGNTL
Cry1Bi D1&2  (398)  TANYSQPYESPGLQLKDSETELPPETTERPNYESYSHRLSHIGIILQTRL
Cry1Bg D1&2  (398)  TANYSQPYESPGLQLKDSETELPPETTERPNYESYSHRLSHIGIILQTRL
Cry1Bf D1&2  (398)  TANYSQPYESPGLQLKDSETELPPETTERPNYESYSHRLSHIGLISQSRV
Cry1Ba D1&2  (398)  TANYSQPYESPGLQLKDSETELPPETTERPNYESYSHRLSHIGIILQSRV
Cry1Bh D1&2  (397)  SLLYTIGYTGVGTQLQDSETELPPETTERPNYESYSHRLSHIGLISSSHV
Cry1Bd D1&2  (399)  ATTYSQPYQGVGIQLFDSETELPPETTERPNYESYSHRLSHIGLIIGNTL
Cry1Bb D1&2  (399)  ATTYSQPYQGVGIQLFDSETELPPETTERPNYESYSHRLSHIGLIIGNTL
Cry1Bc D1&2  (399)  ATTYSQPYQGVGIQLFDSETELPPETTERPNYESYSHRLSHIGLIIGNTL 451       464
MP258  D1&2  (447)  RAPVYSWTHRSAD-
Cry1Be D1&2  (447)  RAPVYSWTHRSADR
Cry1Bi D1&2  (448)  NVPVYSWTHRSADR
Cry1Bg D1&2  (448)  NVPVYSWTHRSADR
Cry1Bf D1&2  (448)  HVPVYSWTHRSADR
Cry1Ba D1&2  (448)  NVPVYSWTHRSADR
Cry1Bh D1&2  (447)  RALVYSWTHRSADR
Cry1Bd D1&2  (449)  RAPVYSWTHRSADR
Cry1Bb D1&2  (449)  RAPVYSWTHRSADR
Cry1Bc D1&2  (449)  RAPVYSWTHRSADR
```

Fig 6A

```
                      1                                                  50
IP1B-B100    (1)   MPSNRKNENEIINALSIPAVSNHSAQMDLSLDARIEDSLCIAEGNNINPL
IP1B-B101    (1)   MPSNRKNENEIINALSIPAVSNHSAQMDLSLDARIEDSLCIAEGNNINPL
IP1B-B102    (1)   MPSNRKNENEIINALSIPAVSNHSAQMDLSLDARIEDSLCIAEGNNINPL
 IP1B-B64    (1)   MPSNRKNENEIINALSIPAVSNHSAQMDLSLDARIEDSLCIAEGNNINPL
 IP1B-B62    (1)   MPSNRKNENEIINALSIPAVSNHSAQMDLSLDARIEDSLCIAEGNNINPL
 IP1B-B63    (1)   MPSNRKNENEIINALSIPAVSNHSAQMDLSLDARIEDSLCIAEGNNINPL
 IP1B-B61    (1)   MPSNRKNENEIINALSIPAVSNHSAQMDLSLDARIEDSLCIAEGNNINPL
 IP1B-B82    (1)   MPSNRKNENEIINALSIPAVSNHSAQMDLSLDARIEDSLCIAEGNNINPL
 IP1B-B83    (1)   MPSNRKNENEIINALSIPAVSNHSAQMDLSLDARIEDSLCIAEGNNINPL
 IP1B-B60    (1)   MPSNRKNENEIINALSIPAVSNHSAQMDLSLDARIEDSLCIAEGNNINPL
 IP1B-B81    (1)   MPSNRKNENEIINALSIPAVSNHSAQMDLSLDARIEDSLCIAEGNNINPL
 IP1B-B65    (1)   MPSNRKNENEIINALSIPAVSNHSAQMDLSLDARIEDSLCIAEGNNINPL
 IP1B-B66    (1)   MPSNRKNENEIINALSIPAVSNHSAQMDLSLDARIEDSLCIAEGNNINPL
 IP1B-B67    (1)   MPSNRKNENEIINALSIPAVSNHSAQMDLSLDARIEDSLCIAEGNNINPL
 IP1B-B68    (1)   MPSNRKNENEIINALSIPAVSNHSAQMDLSLDARIEDSLCIAEGNNINPL
 IP1B-B69    (1)   MPSNRKNENEIINALSIPAVSNHSAQMDLSLDARIEDSLCIAEGNNINPL
 IP1B-B80    (1)   MPSNRKNENEIINALSIPAVSNHSAQMDLSLDARIEDSLCIAEGNNINPL 51                                                 100
IP1B-B100   (51)   VSASTVQTGINIAGRILGVLGVPFAGQLASFYSFIVGELWPSGRDPWEIF
IP1B-B101   (51)   VSASTVQTGINIAGRILGVLGVPFAGQLASFYSFIVGELWPSGRDPWEIF
IP1B-B102   (51)   VSASTVQTGINIAGRILGVLGVPFAGQLASFYSFIVGELWPSGRDPWEIF
 IP1B-B64   (51)   VSASTVQTGINIAGRILGVLGVPFAGQLASFYSFIVGELWPSGRDPWEIF
 IP1B-B62   (51)   VSASTVQTGINIAGRILGVLGVPFAGQLASFYSFIVGELWPSGRDPWEIF
 IP1B-B63   (51)   VSASTVQTGINIAGRILGVLGVPFAGQLASFYSFIVGELWPSGRDPWEIF
 IP1B-B61   (51)   VSASTVQTGINIAGRILGVLGVPFAGQLASFYSFIVGELWPSGRDPWEIF
 IP1B-B82   (51)   VSASTVQTGINIAGRILGVLGVPFAGQLASFYSFIVGELWPSGRDPWEIF
 IP1B-B83   (51)   VSASTVQTGINIAGRILGVLGVPFAGQLASFYSFIVGELWPSGRDPWEIF
 IP1B-B60   (51)   VSASTVQTGINIAGRILGVLGVPFAGQLASFYSFIVGELWPSGRDPWEIF
 IP1B-B81   (51)   VSASTVQTGINIAGRILGVLGVPFAGQLASFYSFIVGELWPSGRDPWEIF
 IP1B-B65   (51)   VSASTVQTGINIAGRILGVLGVPFAGQLASFYSFIVGELWPSGRDPWEIF
 IP1B-B66   (51)   VSASTVQTGINIAGRILGVLGVPFAGQLASFYSFIVGELWPSGRDPWEIF
 IP1B-B67   (51)   VSASTVQTGINIAGRILGVLGVPFAGQLASFYSFIVGELWPSGRDPWEIF
 IP1B-B68   (51)   VSASTVQTGINIAGRILGVLGVPFAGQLASFYSFIVGELWPSGRDPWEIF
 IP1B-B69   (51)   VSASTVQTGINIAGRILGVLGVPFAGQLASFYSFIVGELWPSGRDPWEIF
 IP1B-B80   (51)   VSASTVQTGINIAGRILGVLGVPFAGQLASFYSFIVGELWPSGRDPWEIF
```

Fig 6B

```
                  101                                                    150
IP1B-B100  (101)  MEHVEQLVRQHLTYNARNTALARLQGLGASFRAYQQSLEDWLENRDNART
IP1B-B101  (101)  MEHVEQLVRQHITYNARNTALARLQGLGASFRAYQQSLEDWLENRDNART
IP1B-B102  (101)  MEHVEQLVRQHITYNARNTALARLQGLGASFRAYQQSLEDWLENRDNART
IP1B-B64   (101)  MEHVEQLVRQHITMNARNTALARLQGLGASFRAYQQSLEDWLENRDNART
IP1B-B62   (101)  MEHVEQLVRQHITMNARNTALARLQGLGASFRAYQQSLEDWLENRDNART
IP1B-B63   (101)  MEHVEQLVRQHITMNARNTALARLQGLGASFRAYQQSLEDWLENRDNART
IP1B-B61   (101)  MEHVEQLVRQHITMNARNTALARLQGLGASFRAYQQSLEDWLENRDNART
IP1B-B82   (101)  MEHVEQLVRQHITMNARNTALARLQGLGASFRAYQQSLEDWLENRDNART
IP1B-B83   (101)  MEHVEQLVRQHITMNARNTALARLQGLGASFRAYQQSLEDWLENRDNART
IP1B-B60   (101)  MEHVEQLVRQHITMNARNTALARLQGLGASFRAYQQSLEDWLENRDNART
IP1B-B81   (101)  MEHVEQLVRQHITMNARNTALARLQGLGASFRAYQQSLEDWLENRDNART
IP1B-B65   (101)  MEHVEQLVRQHITMNARNTALARLQGLGASFRAYQQSLEDWLENRDNART
IP1B-B66   (101)  MEHVEQLVRQHITMNARNTALARLQGLGASFRAYQQSLEDWLENRDNART
IP1B-B67   (101)  MEHVEQLVRQHITMNARNTALARLQGLGASFRAYQQSLEDWLENRDNART
IP1B-B68   (101)  MEHVEQLVRQHITMNARNTALARLQGLGASFRAYQQSLEDWLENRDNART
IP1B-B69   (101)  MEHVEQLVRQHITMNARNTALARLQGLGASFRAYQQSLEDWLENRDNART
IP1B-B80   (101)  MEHVEQLVRQHITMNARNTALARLQGLGASFRAYQQSLEDWLENRDNART 151                                                    200
IP1B-B100  (151)  RSVLYTQYIALELDFLNAMPLFAINNQQVPLLMVYAQAANLHLLLLRDAS
IP1B-B101  (151)  RSVLYTQYIALELDFLNAMPLFAINNQQVPLLMVYAQAANLHLLLLRDAS
IP1B-B102  (151)  RSVLYTQYIALELDFLNAMPLFAINNQQVPLLMVYAQAANLHLLLLRDAS
IP1B-B64   (151)  RSVLYTQYIALELDFLNAMPLFAINNQQVPLLMVYAQAANLHLLLLRDAS
IP1B-B62   (151)  RSVLYTQYIALELDFLNAMPLFAINNQQVPLLMVYAQAANLHLLLLRDAS
IP1B-B63   (151)  RSVLYTQYIALELDFLNAMPLFAINNQQVPLLMVYAQAANLHLLLLRDAS
IP1B-B61   (151)  RSVLYTQYIALELDFLNAMPLFAINNQQVPLLMVYAQAANLHLLLLRDAS
IP1B-B82   (151)  RSVLYTQYIALELDFLNAMPLFAINNQQVPLLMVYAQAANLHLLLLRDAS
IP1B-B83   (151)  RSVLYTQYIALELDFLNAMPLFAINNQQVPLLMVYAQAANLHLLLLRDAS
IP1B-B60   (151)  RSVLYTQYIALELDFLNAMPLFAINNQQVPLLMVYAQAANLHLLLLRDAS
IP1B-B81   (151)  RSVLYTQYIALELDFLNAMPLFAINNQQVPLLMVYAQAANLHLLLLRDAS
IP1B-B65   (151)  RSVLYTQYIALELDFLNAMPLFAINNQQVPLLMVYAQAANLHLLLLRDAS
IP1B-B66   (151)  RSVLYTQYIALELDFLNAMPLFAINNQQVPLLMVYAQAANLHLLLLRDAS
IP1B-B67   (151)  RSVLYTQYIALELDFLNAMPLFAINNQQVPLLMVYAQAANLHLLLLRDAS
IP1B-B68   (151)  RSVLYTQYIALELDFLNAMPLFAINNQQVPLLMVYAQAANLHLLLLRDAS
IP1B-B69   (151)  RSVLYTQYIALELDFLNAMPLFAINNQQVPLLMVYAQAANLHLLLLRDAS
IP1B-B80   (151)  RSVLYTQYIALELDFLNAMPLFAINNQQVPLLMVYAQAANLHLLLLRDAS
```

Fig 6C

```
              201                                                  250
IP1B-B100 (201) LFGSEFGLTSQEIQRYYERQAEKTREYSDYCARWYNTGLNNLRGTNAESW
IP1B-B101 (201) LFGSEFGLTRQEIQRYYERQAEKTREYSDYCARWYNTGLNNLRGTNAESW
IP1B-B102 (201) LFGSEFGLTSQEIQRYYERQAEKTREYSDYCARWYNTGLNNLRGHNAESW
 IP1B-B64 (201) LFGSEFGLTSQEIQRYYERQAEKTREYSDYCARWYNTGLNNLRGTNAESW
 IP1B-B62 (201) LFGSEFGLTSQEIQRYYERQAEKTREYSDYCARWYNTGLNNLRGTNAESW
 IP1B-B63 (201) LFGSEFGLTSQEIQRYYERQAEKTREYSDYCARWYNTGLNNLRGTNAESW
 IP1B-B61 (201) LFGSEFGLTSQEIQRYYERQAEKTREYSDYCARWYNTGLNNLRGTNAESW
 IP1B-B82 (201) LFGSEFGLTSQEIQRYYERQAEKTREYSDYCARWYNTGLNNLRGTNAESW
 IP1B-B83 (201) LFGSEFGLTSQEIQRYYERQAEKTREYSDYCARWYNTGLNNLRGTNAESW
 IP1B-B60 (201) LFGSEFGLTSQEIQRYYERQAEKTREYSDYCARWYNTGLNNLRGTNAESW
 IP1B-B81 (201) LFGSEFGLTSQEIQRYYERQAEKTREYSDYCARWYNTGLNNLRGTNAESW
 IP1B-B65 (201) LFGSEFGLTSQEIQRYYERQAEKTREYSDYCARWYNTGLNNLRGTNAESW
 IP1B-B66 (201) LFGSEFGLTSQEIQRYYERQAEKTREYSDYCARWYNTGLNNLRGTNAESW
 IP1B-B67 (201) LFGSEFGLTSQEIQRYYERQAEKTREYSDYCARWYNTGLNNLRGTNAESW
 IP1B-B68 (201) LFGSEFGLTSQEIQRYYERQAEKTREYSDYCARWYNTGLNNLRGTNAESW
 IP1B-B69 (201) LFGSEFGLTSQEIQRYYERQAEKTREYSDYCARWYNTGLNNLRGTNAESW
 IP1B-B80 (201) LFGSEFGLTSQEIQRYYERQAEKTREYSDYCARWYNTGLNNLRGTNAESW 251                                                  300
IP1B-B100 (251) LRYNQFRRDLTLGVLDLVALFPSYDTRIYPINTSAQLTREIYTDPIGRTN
IP1B-B101 (251) LRYNQFRRDLTLGVLDLVALFPSYDTRIYPINTSAQLTREIYTDPIGRTN
IP1B-B102 (251) LRYNQFRRDLTLGVLDLVALFPSYDTRIYPINTSAQLTREIYTDPIGRTN
 IP1B-B64 (251) LRYNQFRRDLTLGVLDLVALFPSYDTRIYPINTSAQLTREIYTDPIGRTN
 IP1B-B62 (251) LRYNQFRRDLTLGVLDLVALFPSYDTRIYPINTSAQLTREIYTDPIGRTN
 IP1B-B63 (251) LRYNQFRRDLTLGVLDLVALFPSYDTRIYPINTSAQLTREIYTDPIGRTN
 IP1B-B61 (251) LRYNQFRRDLTLGVLDLVALFPSYDTRIYPINTSAQLTREIYTDPIGRTN
 IP1B-B82 (251) LRYNQFRRDLTLGVLDLVALFPSYDTRIYPINTSAQLTREIYTDPIGRTN
 IP1B-B83 (251) LRYNQFRRDLTLGVLDLVALFPSYDTRIYPINTSAQLTREIYTDPIGRTN
 IP1B-B60 (251) LRYNQFRRDLTLGVLDLVALFPSYDTRIYPINTSAQLTREIYTDPIGRTN
 IP1B-B81 (251) LRYNQFRRDLTLGVLDLVALFPSYDTRIYPINTSAQLTREIYTDPIGRTN
 IP1B-B65 (251) LRYNQFRRDLTLGVLDLVALFPSYDTRIYPINTSAQLTREIYTDPIGRTN
 IP1B-B66 (251) LRYNQFRRDLTLGVLDLVALFPSYDTRIYPINTSAQLTREIYTDPIGRTN
 IP1B-B67 (251) LRYNQFRRDLTLGVLDLVALFPSYDTRIYPINTSAQLTREIYTDPIGRTN
 IP1B-B68 (251) LRYNQFRRDLTLGVLDLVALFPSYDTRIYPINTSAQLTREIYTDPIGRTN
 IP1B-B69 (251) LRYNQFRRDLTLGVLDLVALFPSYDTRIYPINTSAQLTREIYTDPIGRTN
 IP1B-B80 (251) LRYNQFRRDLTLGVLDLVALFPSYDTRIYPINTSAQLTREIYTDPIGRTN
```

Fig 6D

```
              301                                                  350
IP1B-B100 (301) APSGFASTNWFNNNAPSFSAIEAAIFRPPHLLDFPEQLTIYSASSRWSST
IP1B-B101 (301) APSGFASTNWFNNNAPSFSAIEAAIFRPPHLLDFPEQLTIYSASSRWSST
IP1B-B102 (301) APSGFASTNWFNNNAPSFSAIEAAIFRPPHLLDFPEQLTIYSASSRWSST
 IP1B-B64 (301) APSGFASTNWFNNNAPSFSAIEAAIFRPPHLLDFPEQLTIYSASSRWSST
 IP1B-B62 (301) APSGFASTNWFNNNAPSFSAIEAAIFRPPHLLDFPEQLTIYSASSRWSST
 IP1B-B63 (301) APSGFASTNWFNNNAPSFSAIEAAIFRPPHLLDFPEQLTIYSASSRWSST
 IP1B-B61 (301) APSGFASTNWFNNNAPSFSAIEAAIFRPPHLLDFPEQLTIYSASSRWSST
 IP1B-B82 (301) APSGFASTNWFNNNAPSFSAIEAAIFRPPHLLDFPEQLTIYSASSRWSST
 IP1B-B83 (301) APSGFASTNWFNNNAPSFSAIEAAIFRPPHLLDFPEQLTIYSASSRWSST
 IP1B-B60 (301) APSGFASTNWFNNNAPSFSAIEAAIFRPPHLLDFPEQLTIYSASSRWSST
 IP1B-B81 (301) APSGFASTNWFNNNAPSFSAIEAAIFRPPHLLDFPEQLTIYSASSRWSST
 IP1B-B65 (301) APSGFASTNWFNNNAPSFSAIEAAIFRPPHLLDFPEQLTIYSASSRWSST
 IP1B-B66 (301) APSGFASTNWFNNNAPSFSAIEAAIFRPPHLLDFPEQLTIYSASSRWSST
 IP1B-B67 (301) APSGFASTNWFNNNAPSFSAIEAAIFRPPHLLDFPEQLTIYSASSRWSST
 IP1B-B68 (301) APSGFASTNWFNNNAPSFSAIEAAIFRPPHLLDFPEQLTIYSASSRWSST
 IP1B-B69 (301) APSGFASTNWFNNNAPSFSAIEAAIFRPPHLLDFPEQLTIYSASSRWSST
 IP1B-B80 (301) APSGFASTNWFNNNAPSFSAIEAAIFRPPHLLDFPEQLTIYSASSRWSST 351                                                  400
IP1B-B100 (351) QHMNYWVGHRLNFRPIGGTLNTSTHGATNTSINPVTLQFTSRDVYRTESY
IP1B-B101 (351) QHMNYWVGHRLNFRPIGGTLNTSTHGATNTSINPVTLQFTSRDVYRTESY
IP1B-B102 (351) QHMNYWVGHRLNFRPIGGTLNTSTHGATNTSINPVTLQFTSRDVYRTESY
 IP1B-B64 (351) QHMNYWVGHRLNFRPIGGTLNTSTHGATNTSINPVTLQFTSRDVYRTESY
 IP1B-B62 (351) QHMNYWVGHRLNFRPIGGTLNTSTHGATNTSINPVTLQFTSRDVYRTESY
 IP1B-B63 (351) QHMNYWVGHRLNFRPIGGTLNTSTHGATNTSINPVTLQFTSRDVYRTESY
 IP1B-B61 (351) QHMNYWVGHRLNFRPIGGTLNTSTHGATNTSINPVTLQFTSRDVYRTESY
 IP1B-B82 (351) QHMNYWVGHRLNFRPIGGTLNTSTHGATNTSINPVTLQFTSRDVYRTESY
 IP1B-B83 (351) QHMNYWVGHRLNFRPIGGTLNTSTHGATNTSINPVTLQFTSRDVYRTESY
 IP1B-B60 (351) QHMNYWVGHRLYFRPIGGTLNTSTHGATNTSINPVTLQFTSRDVYRTESY
 IP1B-B81 (351) QHMNYWVGHRLYFRPIGGTLNTSTHGATNTSINPVTLQFTSRDVYRTESY
 IP1B-B65 (351) QHMNYWVGHRLYFRPIGGTLNTSTHGATNTSINPVTLQFTSRDVYRTESY
 IP1B-B66 (351) QHMNYWVGHRLYFRPIGGTLNTSTHGATNTSINPVTLQFTSRDVYRTESY
 IP1B-B67 (351) QHMNYWVGHRLYFRPIGGTLNTSTHGATNTSINPVTLQFTSRDVYRTESY
 IP1B-B68 (351) QHMNYWVGHRLYFRPIGGTLNTSTHGATNTSINPVTLQFTSRDVYRTESY
 IP1B-B69 (351) QHMNYWVGHRLYFRPIGGTLNTSTHGATNTSINPVTLQFTSRDVYRTESY
 IP1B-B80 (351) QHMNYWVGHRLYFRPIGGTLNTSTHGATNTSINPVTLQFTSRDVYRTESY
```

Fig 6E

```
                    401                                                      450
IP1B-B100   (401)   AGINILLTTPVNGVPWARFNWRNPLNSLRGSLLYTIGYTGVGTQLFDSET
IP1B-B101   (401)   AGINILLTTPVNGVPWARFNWRNPLNSLRGSLLYTIGYTGVGTQLFDSET
IP1B-B102   (401)   AGINILLTTPVNGVPWARFNWRNPLNSLRGSLLYTIGYTGVGTQLFDSET
 IP1B-B64   (401)   AGINILLTTPVNGVPWARFNWRNPLNSLRGSLLYTIGYTGVGTQLFDSET
 IP1B-B62   (401)   AGINILLTTPVNGVPWARFNWRNPLNSLRGSLLYTIGYTGVGTQLFDSET
 IP1B-B63   (401)   AGINILLTTPVNGVPWARFNWRNPLNSLRGSLLYTIGYTGVGTQLFDSET
 IP1B-B61   (401)   AGINILLTTPVNGVPWARFNWRNPLNSLRGSLLYTIGYTGVGTQLFDSET
 IP1B-B82   (401)   AGINILLTTPVNGVPWARFNWRNPLNSLRGSLLYTIGYTGVGTQLFDSET
 IP1B-B83   (401)   AGINILLTTPVNGVPWARFNWRNPLNSLRGSLLYTIGYTGVGTQLFDSET
 IP1B-B60   (401)   AGINILLTTPVNGVPWARFNWRNPLNSLRGSLLYTIGYTGVGTQLFDSET
 IP1B-B81   (401)   AGINILLTTPVNGVPWARFNWRNPLNSLRGSLLYTIGYTGVGTQLFDSET
 IP1B-B65   (401)   AGINILLTTPVNGVPWARFNWRNPLNSLRGSLLYTIGYTGVGTQLFDSET
 IP1B-B66   (401)   AGINILLTTPVNGVPWARFNWRNPLNSLRGSLLYTIGYTGVGTQLFDSET
 IP1B-B67   (401)   AGINILLTTPVNGVPWARFNWRNPLNSLRGSLLYTIGYTGVGTQLFDSET
 IP1B-B68   (401)   AGINILLTTPVNGVPWARFNWRNPLNSLRGSLLYTIGYTGVGTQLFDSET
 IP1B-B69   (401)   AGINILLTTPVNGVPWARFNWRNPLNSLRGSLLYTIGYTGVGTQLFDSET
 IP1B-B80   (401)   AGINILLTTPVNGVPWARFNWRNPLNSLRGSLLYTIGYTGVGTQLFDSET 451                                                      500
IP1B-B100   (451)   ELPPETTERPNYESYSHRLSNIRLIIGGTLRAPVYSWTHRSADRTNTIAT
IP1B-B101   (451)   ELPPETTERPNYESYSHRLSNIRLIIGGTLRAPVYSWTHRSADRTNTIAT
IP1B-B102   (451)   ELPPETTERPNYESYSHRLSNIRLIIGGTLRAPVYSWTHRSADRTNTIAT
 IP1B-B64   (451)   ELPPETTERPNYESYSHRLSNIRLIIGGTLRAPVYSWTHRSADRTNTIAT
 IP1B-B62   (451)   ELPPETTERPNYESYSHRLSNIRLIIGGTLRAPVYSWTHRSADRTNTIAT
 IP1B-B63   (451)   ELPPETTERPNYESYSHRLSNIRLIIGGTLRAPVYSWTHRSADRTNTIAT
 IP1B-B61   (451)   ELPPETTERPNYESYSHRLSNIRLIIGGTLRAPVYSWTHRSADRTNTIAT
 IP1B-B82   (451)   ELPPETTERPNYESYSHRLSNIRLIIGGTLRAPVYSWTHRSADRTNTIAT
 IP1B-B83   (451)   ELPPETTERPNYESYSHRLSNIRLIIGGTLRAPVYSWTHRSADRTNTIAT
 IP1B-B60   (451)   ELPPETTERPNYESYSHRLSNIRLIIGGTLRAPVYSWTHRSADRTNTIAT
 IP1B-B81   (451)   ELPPETTERPNYESYSHRLSNIRLIIGGTLRAPVYSWTHRSADRTNTIAT
 IP1B-B65   (451)   ELPPETTERPNYESYSHRLSNIRLIIGGTLRAPVYSWTHRSADRTNTIAT
 IP1B-B66   (451)   ELPPETTERPNYESYSHRLSNIRLIIGGTLRAPVYSWTHRSADRTNTIAT
 IP1B-B67   (451)   ELPPETTERPNYESYSHRLSNIRLIIGGTLRAPVYSWTHRSADRTNTIAT
 IP1B-B68   (451)   ELPPETTERPNYESYSHRLSNIRLIIGGTLRAPVYSWTHRSADRTNTIAT
 IP1B-B69   (451)   ELPPETTERPNYESYSHRLSNIRLIIGGTLRAPVYSWTHRSADRTNTIAT
 IP1B-B80   (451)   ELPPETTERPNYESYSHRLSNIRLIIGGTLRAPVYSWTHRSADRTNTIAT
```

Fig 6F

```
                    501                                                  550
IP1B-B100   (501)   NIITQIPAVKGNFLFNGLVISGPGFTGGDLVRLNNSGNNIQNRGYIEVPI
IP1B-B101   (501)   NIITQIPAVKGNFLFNGLVISGPGFTGGDLVRLNNSGNNIQNRGYIEVPI
IP1B-B102   (501)   NIITQIPAVKGNFLFNGLVISGPGFTGGDLVRLNNSGNNIQNRGYIEVPI
 IP1B-B64   (501)   NIITQIPAVKGNFLFNGLVISGPGFTGGDLVRLNNSGNNIQNRGYIEVPI
 IP1B-B62   (501)   NIITQIPAVKGNFLFNGLVISGPGFTGGDLVRLNNSGNNIQNRGYIEVPI
 IP1B-B63   (501)   NIITQIPAVKGNFLFNGLVISGPGFTGGDLVRLNNSGNNIQNRGYIEVPI
 IP1B-B61   (501)   NIITQIPAVKGNFLFNGLVISGPGFTGGDLVRLNNSGNNIQNRGYIEVPI
 IP1B-B82   (501)   NIITQIPAVKGNFLFNGLVISGPGFTGGDLVRLNNSGNNIQNRGYIEVPI
 IP1B-B83   (501)   NIITQIPAVKGNFLFNGLVISGPGFTGGDLVRLNNSGNNIQNRGYIEVPI
 IP1B-B60   (501)   NIITQIPAVKGNFLFNGLVISGPGFTGGDLVRLNNSGNNIQNRGYIEVPI
 IP1B-B81   (501)   NIITQIPAVKGNFLFNGLVISGPGFTGGDLVRLNNSGNNIQNRGYIEVPI
 IP1B-B65   (501)   NIITQIPAVKGNFLFNGLVISGPGFTGGDLVRLNNSGNNIQNRGYIEVPI
 IP1B-B66   (501)   NIITQIPAVKGNFLFNGLVISGPGFTGGDLVRLNNSGNNIQNRGYIEVPI
 IP1B-B67   (501)   NIITQIPAVKGNFLFNGLVISGPGFTGGDLVRLNNSGNNIQNRGYIEVPI
 IP1B-B68   (501)   NIITQIPAVKGNFLFNGLVISGPGFTGGDLVRLNNSGNNIQNRGYIEVPI
 IP1B-B69   (501)   NIITQIPAVKGNFLFNGLVISGPGFTGGDLVRLNNSGNNIQNRGYIEVPI
 IP1B-B80   (501)   NIITQIPAVKGNFLFNGLVISGPGFTGGDLVRLNNSGNNIQNRGYIEVPI 551                                                  600
IP1B-B100   (551)   QFISTSTRYRVRVRYASVTPIRLSVNWGNSNIFSSIVPATATSLDNLQSR
IP1B-B101   (551)   QFISTSTRYRVRVRYASVTPIRLSVNWGNSNIFSSIVPATATSLDNLQSR
IP1B-B102   (551)   QFISTSTRYRVRVRYASVTPIRLSVNWGNSNIFSSIVPATATSLDNLQSR
 IP1B-B64   (551)   QFISTSTRYRVRVRYASVTPIRLSVNWGNSNIFSSIVPATATSLDNLQSR
 IP1B-B62   (551)   QFISTSTRYRVRVRYASVTPIRLSVNWGNSNIFSSIVPATATSLDNLQSR
 IP1B-B63   (551)   QFISTSTRYRVRVRYASVTPIRLSVNWGNSNIFSSIVPATATSLDNLQSR
 IP1B-B61   (551)   QFRSTSTRYRVRVRYASVTPIRLSVNWGNSNIFSSIVPATATSLDNLQSR
 IP1B-B82   (551)   QFRSTSTRYRVRVRYASVTPIRLSVNWGNSNIFSSIVPATATSLDTLQSR
 IP1B-B83   (551)   QFRSTSTRYRVRVRYASVTPIRLSVNWGNSNIFSSIVPATATSLDVLQSR
 IP1B-B60   (551)   QFISTSTRYRVRVRYASVTPIRLSVNWGNSNIFSSIVPATATSLDNLQSR
 IP1B-B81   (551)   QFISTSTRYRVRVRYASVTPIRLSVNWGNSNIFSSIVPATATSLDVLQSR
 IP1B-B65   (551)   QFISTSTRYRVRVRYASVTPIRLSVNWGNSNIFSSIVPATATSLSNLQSR
 IP1B-B66   (551)   QFISTSTRYRVRVRYASVTPIRLSVNWGNSNIFSSIVPATATSLSNLQSR
 IP1B-B67   (551)   QFISTSTRYRVRVRYASVTPIRLSVNWGNSNIFSSIVPATATSLSTLQSR
 IP1B-B68   (551)   QFISTSTRYRVRVRYASVTPIRLSVNWGNSNIFSSIVPATATSLSVLQSR
 IP1B-B69   (551)   QFISTSTRYRVRVRYASVTPIRLSVNWGNSNIFSSIVPATATSLSVLQSR
 IP1B-B80   (551)   QFISTSTRYRVRVRYASVTPIRLSVNWGNSNIFSSIVPATATSLDTLQSR
```

Fig 6G

```
                    601                                                      650
IP1B-B100   (601)   NFGYFESRNAFTSATGNVVGVRNFSENAGVIIDRFEFIPVTATFEHEYDL
IP1B-B101   (601)   NFGYFESRNAFTSATGNVVGVRNFSENAGVIIDRFEFIPVTATFEHEYDL
IP1B-B102   (601)   NFGYFESRNAFTSATGNVVGVRNFSENAGVIIDRFEFIPVTATFEHEYDL
 IP1B-B64   (601)   NFGYFESRNAFTSATGNVVGVRNFSENAGVIIDRFEFIPVTATFEHEYDL
 IP1B-B62   (601)   NFGYFESRNAFTSATGNVVGVRNFSENAGVIIDRFEFIPVTATFLAEYDL
 IP1B-B63   (601)   NFGYFESRNAFTSATGNVVGVRNFSENAGVIIDRFEFIPVTATFTAEYDL
 IP1B-B61   (601)   NFGYFESRNAFTSATGNVVGVRNFSENAGVIIDRFEFIPVTATFEAEYDL
 IP1B-B82   (601)   NFGYFHSRNAFTSATGNVVGVRNFSENAGVIIDRFEFIPVTATFEAEYDL
 IP1B-B83   (601)   NFGYFHSRNAFTSATGNVVGVRNFSENAGVIIDRFEFIPVTATFEAEYDL
 IP1B-B60   (601)   NFGYFESRNAFTSATGNVVGVRNFSENAGVIIDRFEFIPVTATFEAEYDL
 IP1B-B81   (601)   NFGYFHSRNAFTSATGNVVGVRNFSENAGVIIDRFEFIPVTATFEAEYDL
 IP1B-B65   (601)   NFGYFHSRNAFTSATGNVVGVRNFSENAGVIIDRFEFIPVTATFEAEYDL
 IP1B-B66   (601)   NFGYFQSRNAFTSATGNVVGVRNFSENAGVIIDRFEFIPVTATFEAEYDL
 IP1B-B67   (601)   NFGYFHSRNAFTSATGNVVGVRNFSENAGVIIDRFEFIPVTATFEAEYDL
 IP1B-B68   (601)   NFGYFESRNAFTSATGNVVGVRNFSENAGVIIDRFEFIPVTATFEAEYDL
 IP1B-B69   (601)   NFGYFQSRNAFTSATGNVVGVRNFSENAGVIIDRFEFIPVTATFEAEYDL
 IP1B-B80   (601)   NFGYFQSRNAFTSATGNVVGVRNFSENAGVIIDRFEFIPVTATFEAEYDL

651
IP1B-B100   (651)   ERAQE
IP1B-B101   (651)   ERAQE
IP1B-B102   (651)   ERAQE
 IP1B-B64   (651)   ERAQE
 IP1B-B62   (651)   ERAQE
 IP1B-B63   (651)   ERAQE
 IP1B-B61   (651)   ERAQE
 IP1B-B82   (651)   ERAQE
 IP1B-B83   (651)   ERAQE
 IP1B-B60   (651)   ERAQE
 IP1B-B81   (651)   ERAQE
 IP1B-B65   (651)   ERAQE
 IP1B-B66   (651)   ERAQE
 IP1B-B67   (651)   ERAQE
 IP1B-B68   (651)   ERAQE
 IP1B-B69   (651)   ERAQE
 IP1B-B80   (651)   ERAQE
```

Fig. 7A

```
              1                                                  50
Cry1Bd   (1)  MTSNRKNENEIINALSIPAVSNHSAQMDLSLDARIEDSLCIAEGNNINPL
MO2-01   (1)  MPSNRKNENEIINALSIPAVSNHSAQMDLSLDARIEDSLCIAEGNNINPL
MP258    (1)  MTSNRKNENEIINALSIPAVSNHSAQMDLSPDARIEDSLCIAEGNNINPL
MO2-02   (1)  MTSNRKNENEIINALSIPAVSNHSAQMDLSPDARIEDSLCIAEGNNINPL 51                                                100
Cry1Bd  (51)  VSASTVQTGINIAGRILGVLGVPFAGQLASFYSFLVGELWPSGRDPWEIF
MO2-01  (51)  VSASTVQTGINIAGRILGVLGVPFAGQLASFYSFLVGELWPSGRDPWEIF
MP258   (51)  VSASTVQTGINIAGRILGVLGVPFAGQLASFYSFIVGELWPSGRDPWEIF
MO2-02  (51)  VSASTVQTGINIAGRILGVLGVPFAGQLASFYSFIVGELWPSGRDPWEIF 101                                               150
Cry1Bd (101)  LEHVEQLIRQQVTENTRNTAIARLEGLGRGYRSYQQALETWLDNRNDARS
MO2-01 (101)  LEHVEQLIRQQVTENTRNTAIARLEGLGRGYRSYQQALETWLDNRNDARS
MP258  (101)  LEHVEQLVRQQITENARNTALARLQGLGASFRAYQQSLEDWLENRDDART
MO2-02 (101)  LEHVEQLVRQQITENARNTALARLQGLGASFRAYQQSLEDWLENRDDART 151                                               200
Cry1Bd (151)  RSIILERYVALELDITTAIPLFRIRNEEVPLLMVYAQAANLHLLLLRDAS
MO2-01 (151)  RSIILERYVALELDITTAIPLFRIRNEEVPLLMVYAQAANLHLLLLRDAS
MP258  (151)  RSVLYTQYIALELDFLNAMPLFAINNQQVPLLMVYAQAANLHLLLLRDAS
MO2-02 (151)  RSVLYTQYIALELDFLNAMPLFAINNQQVPLLMVYAQAANLHLLLLRDAS 201                                               250
Cry1Bd (201)  LFGSEWGMASSDVNQYYQEQIRYTEEYSNHCVQWYNTGLNNLRGTNAESW
MO2-01 (201)  LFGSEWGMASSDVNQYYQEQIRYTEEYSNHCVQWYNTGLNNLRGTNAESW
MP258  (201)  LFGSEFGLTSQEIQRYYERQAEKTREYSDYCARWYNTGLNNLRGTNAESW
MO2-02 (201)  LFGSEFGLTSQEIQRYYERQAEKTREYSDYCARWYNTGLNNLRGTNAESW 251                                               300
Cry1Bd (251)  LRYNQFRRDLTLGVLDLVALFPSYDTRTYPINTSAQLTREIYTDPIGRTN
MO2-01 (251)  LRYNQFRRDLTLGVLDLVALFPSYDTRTYPINTSAQLTREIYTDPIGRTN
MP258  (251)  LRYNQFRRDLTLGVLDLVALFPSYDTRIYPINTSAQLTREIYTDPIGRTN
MO2-02 (251)  LRYNQFRRDLTLGVLDLVALFPSYDTRIYPINTSAQLTREIYTDPIGRTN 301                                               350
Cry1Bd (301)  APSGFASTNWFNNNAPSFSAIEAAIFRPPHLLDFPEQLTIYSASSRWSST
MO2-01 (301)  APSGFASTNWFNNNAPSFSAIEAAVIRPPHLLDFPEQLTIFSVLSRWSNT
MP258  (301)  APSGFASTNWFNNNAPSFSAIEAAVIRPPHLLDFPEQLTIFSVLSRWSNT
MO2-02 (301)  APSGFASTNWFNNNAPSFSAIEAAIFRPPHLLDFPEQLTIYSASSRWSST
```

Fig. 7B

```
              351                                              400
Cry1Bd (351)  QHMNYWVGHRLNFRPIGGTLNTSTQGLTNNTSINPVTLQFTSRDVYRTES
MO2-01 (351)  QYMNYWVGHRLESRTIRGSLSTSTHGNTN-TSINPVTLQFTSRDVYRTES
 MP258 (351)  QYMNYWVGHRLESRTIRGSLSTSTHGNTN-TSINPVTLQFTSRDVYRTES
MO2-02 (351)  QHMNYWVGHRLNFRPIGGTLNTSTQGLTNNTSINPVTLQFTSRDVYRTES 401                                              450
Cry1Bd (401)  NAGTNILFTTPVNGVPWARFNFINPQNIYERGATTYSQFYQGVGIQLFDS
MO2-01 (400)  YAGINILLTTPVNGVPWARFNWRNPLNSLR-GSLLYTIGYTGVGTQLFDS
 MP258 (400)  YAGINILLTTPVNGVPWARFNWRNPLNSLR-GSLLYTIGYTGVGTQLFDS
MO2-02 (401)  NAGTNILFTTPVNGVPWARFNFINPQNIYERGATTYSQFYQGVGIQLFDS 451                                              500
Cry1Bd (451)  ETELPPETTERPNYESYSHRLSHIGLIIGNTLRAPVYSWTHRSADRTNTI
MO2-01 (449)  ETELPPETTERPNYESYSHRLSNIRLISGNTLRAPVYSWTHRSADRTNTI
 MP258 (449)  ETELPPETTERPNYESYSHRLSNIRLISGNTLRAPVYSWTHRSADRTNTI
MO2-02 (451)  ETELPPETTERPNYESYSHRLSHIGLIIGNTLRAPVYSWTHRSADRTNTI 501                                              550
Cry1Bd (501)  GPNRITQIPAVKGRFLFNGSVISGPGFTGGDVVRLNRNNGNIQNRGYIEV
MO2-01 (499)  ATNIITQIPAVKGNFLFNGSVISGPGFTGGDLVRLNNSGNNIQNRGYLEV
 MP258 (499)  ATNIITQIPAVKGNFLFNGSVISGPGFTGGDLVRLNNSGNNIQNRGYLEV
MO2-02 (501)  ATNIITQIPAVKGNFLFNGSVISGPGFTGGDLVRLNNSGNNIQNRGYLEV 551                                              600
Cry1Bd (551)  PIQFTSTSTRYRVRVRYASVTSIELNVNLGNSSIFTNTLPATAASLDNLQ
MO2-01 (549)  PIQFISTSTRYRVRVRYASVTPIQLSVNWGNSNIFSSIVPATATSLDNLQ
 MP258 (549)  PIQFISTSTRYRVRVRYASVTPIQLSVNWGNSNIFSSIVPATATSLDNLQ
MO2-02 (551)  PIQFISTSTRYRVRVRYASVTPIQLSVNWGNSNIFSSIVPATATSLDNLQ 601                                              650
Cry1Bd (601)  SGDFGYVEINNAFTSATGNIVGARNFSANAEVIIDRFEFIPVTATFEAEY
MO2-01 (599)  SRDFGYFESTNAFTSATGNVVGVRNFSENAGVIIDRFEFIPVTATFEAEY
 MP258 (599)  SRDFGYFESTNAFTSATGNVVGVRNFSENAGVIIDRFEFIPVTATFEAEY
MO2-02 (601)  SRDFGYFESTNAFTSATGNVVGVRNFSENAGVIIDRFEFIPVTATFEAEY

651
Cry1Bd (651)  DLERAQK
MO2-01 (649)  DLERAQE
 MP258 (649)  DLERAQE
MO2-02 (651)  DLERAQE
```

Fig 8

```
              101                                                  150
Cry1Bd  (101) LEHVEQLIRQQVTENTRNTAIARLEGLGRGYRSYQQALETWLDNRNDARS
MO5-02  (101) LEHVEQLVRQQITENARNTALARLQGLGASFRAYQQSLEDWLENRDDARS
MO5-03  (101) LEHVEQLIRQQVTENTRNTAIARLEGLGRGYRSYQQALETWLDNRNDART
MO5-05  (101) LEHVEQLVRQQITENARNTALARLQGLGASFRAYQQSLEDWLENRDDART
MO5-04  (101) LEHVEQLIRQQVTENTRNTAIARLEGLGRGYRSYQQALETWLDNRNDARS
MO5-07  (101) LEHVEQLVRQQITENARNTALARLQGLGASFRAYQQSLEDWLENRDDARS
MO5-01  (101) LEHVEQLVRQQITENARNTALARLQGLGASFRAYQQSLEDWLENRDDART
MO5-06  (101) LEHVEQLIRQQVTENTRNTAIARLEGLGRGYRSYQQALETWLDNRNDART 151                                                  200
Cry1Bd  (151) RSIILERYVALELDITTAIPLFRIRNEEVPLLMVYAQAANLHLLLLRDAS
MO5-02  (151) RSIILERYVALELDITTAIPLFRIRNEEVPLLMVYAQAANLHLLLLRDAS
MO5-03  (151) RSVLYTQYIALELDFLNAMPLFAINNQQVPLLMVYAQAANLHLLLLRDAS
MO5-05  (151) RSVLYTQYIALELDFLNAMPLFAINNQQVPLLMVYAQAANLHLLLLRDAS
MO5-04  (151) RSIILERYVALELDITTAIPLFRIRNEEVPLLMVYAQAANLHLLLLRDAS
MO5-07  (151) RSIILERYVALELDITTAIPLFRIRNEEVPLLMVYAQAANLHLLLLRDAS
MO5-01  (151) RSVLYTQYIALELDFLNAMPLFAINNQQVPLLMVYAQAANLHLLLLRDAS
MO5-06  (151) RSVLYTQYIALELDFLNAMPLFAINNQQVPLLMVYAQAANLHLLLLRDAS 201                                                  250
Cry1Bd  (201) LFGSEWGMASSDVNQYYQEQIRYTEEYSNHCVQWYNTGLNNLRGTNAESW
MO5-02  (201) LFGSEWGMASSDVNQYYQEQIRYTEEYSNHCVQWYNTGLNNLRGTNAESW
MO5-03  (201) LFGSEWGMASSDVNQYYQEQIRYTEEYSNHCVQWYNTGLNNLRGTNAESW
MO5-05  (201) LFGSEWGMASSDVNQYYQEQIRYTEEYSNHCVQWYNTGLNNLRGTNAESW
MO5-04  (201) LFGSEFGLTSQEIQRYYERQAEKTREYSDYCARWYNTGLNNLRGTNAESW
MO5-07  (201) LFGSEFGLTSQEIQRYYERQAEKTREYSDYCARWYNTGLNNLRGTNAESW
MO5-01  (201) LFGSEFGLTSQEIQRYYERQAEKTREYSDYCARWYNTGLNNLRGTNAESW
MO5-06  (201) LFGSEFGLTSQEIQRYYERQAEKTREYSDYCARWYNTGLNNLRGTNAESW
```

Fig. 9

```
              101                                               150
MP258 (101)   LEHVEQLVRQQITENARNTALARLQGLGASFRAYQQSLEDWLENRDDART
MO4-02 (101)  LEHVEQLVRQQVTENTRNTAIARLEGLGRGYRSYQQALETWLDNRDDART
MO4-03 (101)  LEHVEQLVRQQITENARNTALARLQGLGASFRAYQQSLEDWLENRNDARS
MO4-05 (101)  LEHVEQLVRQQVTENTRNTAIARLEGLGRGYRSYQQALETWLDNRNDARS
MO4-01 (101)  LEHVEQLIRQQVTENTRNTAIARLEGLGRGYRSYQQALETWLDNRNDARS
MO4-06 (101)  LEHVEQLVRQQITENARNTALARLQGLGASFRAYQQSLEDWLENRNDARS
MO4-04 (101)  LEHVEQLVRQQITENARNTALARLQGLGASFRAYQQSLEDWLENRDDART
MO4-07 (101)  LEHVEQLVRQQVTENTRNTAIARLEGLGRGYRSYQQALETWLDNRDDART 151                                               200
MP258 (151)   RSVLYTQYIALELDFLNAMPLFAINNQQVPLLMVYAQAANLHLLLLRDAS
MO4-02 (151)  RSVLYTQYIALELDFLNAMPLFAINNQQVPLLMVYAQAANLHLLLLRDAS
MO4-03 (151)  RSIILERYVALELDITTAIPLFRIRNEEVPLLMVYAQAANLHLLLLRDAS
MO4-05 (151)  RSIILERYVALELDITTAIPLFRIRNEEVPLLMVYAQAANLHLLLLRDAS
MO4-01 (151)  RSIILERYVALELDITTAIPLFRIRNEEVPLLMVYAQAANLHLLLLRDAS
MO4-06 (151)  RSIILERYVALELDITTAIPLFRIRNEEVPLLMVYAQAANLHLLLLRDAS
MO4-04 (151)  RSVLYTQYIALELDFLNAMPLFAINNQQVPLLMVYAQAANLHLLLLRDAS
MO4-07 (151)  RSVLYTQYIALELDFLNAMPLFAINNQQVPLLMVYAQAANLHLLLLRDAS 201                                               250
MP258 (201)   LFGSEFGLTSQEIQRYYERQAEKTREYSDYCARWYNTGLNNLRGTNAESW
MO4-02 (201)  LFGSEFGLTSQEIQRYYERQAEKTREYSDYCARWYNTGLNNLRGTNAESW
MO4-03 (201)  LFGSEFGLTSQEIQRYYERQAEKTREYSDYCARWYNTGLNNLRGTNAESW
MO4-05 (201)  LFGSEFGLTSQEIQRYYERQAEKTREYSDYCARWYNTGLNNLRGTNAESW
MO4-01 (201)  LFGSEWGMASSDVNQYYQEQIRYTEEYSNHCVQWYNTGLNNLRGTNAESW
MO4-06 (201)  LFGSEWGMASSDVNQYYQEQIRYTEEYSNHCVQWYNTGLNNLRGTNAESW
MO4-04 (201)  LFGSEWGMASSDVNQYYQEQIRYTEEYSNHCVQWYNTGLNNLRGTNAESW
MO4-07 (201)  LFGSEWGMASSDVNQYYQEQIRYTEEYSNHCVQWYNTGLNNLRGTNAESW
```

INSECTICIDAL CRY1B VARIANTS HAVING IMPROVED ACTIVITY SPECTRUM AND USES THEREOF

CROSS-REFERENCE TO RELATED APPLICATIONS

This application is a 371 (National Stage) of PCT/US17/27160 filed Apr. 12, 2017, which claims priority to U.S. Provisional Application No. 62/322,535, filed Apr. 14, 2016, which is hereby incorporated herein in its entirety by reference.

REFERENCE TO SEQUENCE LISTING SUBMITTED ELECTRONICALLY

A sequence listing having the file name "7115USPCT_SequenceListing.txt" created on Jul. 13, 2018 and having a size of 824 kilobytes is filed in computer readable form concurrently with the specification. The sequence listing is part of the specification and is herein incorporated by reference in its entirety.

FIELD

The present disclosure relates to recombinant nucleic acids that encode pesticidal polypeptides having insecticidal activity against corn earworm and/or fall armyworm and/or an improved spectrum of pesticidal activity against insect pests. Compositions and methods of the disclosure utilize the disclosed nucleic acids, and their encoded pesticidal polypeptides, to control plant pests.

BACKGROUND

Insect pests are a major factor in the loss of the world's agricultural crops. For example, armyworm feeding, black cutworm damage, or European corn borer damage can be economically devastating to agricultural producers. Insect pest-related crop loss from European corn borer attacks on field and sweet corn alone has reached about one billion dollars a year in damage and control expenses.

Traditionally, the primary method for impacting insect pest populations is the application of broad-spectrum chemical insecticides. However, consumers and government regulators alike are becoming increasingly concerned with the environmental hazards associated with the production and use of synthetic chemical pesticides. Because of such concerns, regulators have banned or limited the use of some of the more hazardous pesticides. Thus, there is substantial interest in developing alternative pesticides.

Biological control of insect pests of agricultural significance using a microbial agent, such as fungi, bacteria, or another species of insect affords an environmentally friendly and commercially attractive alternative to synthetic chemical pesticides. Generally speaking, the use of biopesticides presents a lower risk of pollution and environmental hazards, and biopesticides provide greater target specificity than is characteristic of traditional broad-spectrum chemical insecticides. In addition, biopesticides often cost less to produce and thus improve economic yield for a wide variety of crops.

Certain species of microorganisms of the genus *Bacillus* are known to possess pesticidal activity against a broad range of insect pests including Lepidoptera, Diptera, Coleoptera, Hemiptera, and others. *Bacillus thuringiensis* (Bt) and *Bacillus papilliae* are among the most successful biocontrol agents discovered to date. Insect pathogenicity has also been attributed to strains of *B. larvae, B. lentimorbus, B. sphaericus* (Harwook, ed., ((1989) *Bacillus* (Plenum Press), 306), and *B. cereus* (WO 96/10083). Pesticidal activity appears to be concentrated in parasporal crystalline protein inclusions, although pesticidal proteins have also been isolated from the vegetative growth stage of *Bacillus*. Several genes encoding these pesticidal proteins have been isolated and characterized (see, for example, U.S. Pat. Nos. 5,366,892 and 5,840,868).

Microbial insecticides, particularly those obtained from *Bacillus* strains, have played an important role in agriculture as alternatives to chemical pest control. Recently, agricultural scientists have developed crop plants with enhanced insect resistance by genetically engineering crop plants to produce pesticidal proteins from *Bacillus*. For example, corn and cotton plants have been genetically engineered to produce pesticidal proteins isolated from strains of Bt (see, e.g., Aronson (2002) *Cell Mol. Life Sci.* 59(3):417-425; Schnepf et al. (1998) *Microbiol Mol Biol Rev.* 62(3):775-806). These genetically engineered crops are now widely used in American agriculture and have provided the farmer with an environmentally friendly alternative to traditional insect-control methods. In addition, potatoes genetically engineered to contain pesticidal Cry toxins have been sold to the American farmer. While they have proven to be very successful commercially, these genetically engineered, insect-resistant crop plants provide resistance to only a narrow range of the economically important insect pests.

Accordingly, there remains a need for new Bt toxins with an improved spectrum of insecticidal activity against insect pests, e.g., toxins which are improved actives against insects from the order Lepidoptera and/or Coleoptera. In addition, there remains a need for biopesticides having activity against a variety of insect pests and for biopesticides which have improved insecticidal activity.

SUMMARY

Compositions and methods are provided for impacting insect pests. More specifically, the embodiments of the present disclosure relate to methods of impacting insects utilizing nucleotide sequences encoding insecticidal peptides to produce transformed microorganisms and plants that express an insecticidal polypeptide of the embodiments. In some embodiments, the nucleotide sequences encode polypeptides that are pesticidal for at least one insect belonging to the order Lepidoptera.

In some aspects nucleic acid molecules and fragments and variants thereof are provided, which encode polypeptides that possess pesticidal activity against insect pests (e.g. SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, and SEQ ID NO: 46, and encoding the polypeptide of SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43 or SEQ ID NO: 45, respectively). The embodiments further provide fragments and variants of the disclosed nucleotide sequence that encode biologically active (e.g., insecticidal) polypeptides.

In another aspect variant Cry1B polypeptides are provided, encoded by a modified (e.g., mutagenized or manipulated) nucleic acid molecule of the embodiments. In particular examples, pesticidal proteins of the embodiments include fragments of full-length proteins and polypeptides that are produced from mutagenized nucleic acids designed to introduce particular amino acid sequences into the polypeptides of the embodiments. In particular embodiments, the polypeptides have enhanced pesticidal activity relative to the activity of the naturally occurring polypeptide from which they are derived.

In another aspect chimeric Cry1B polypeptides are provided.

In another aspect the nucleic acids of the embodiments can also be used to produce transgenic (e.g., transformed) monocot or dicot plants that are characterized by genomes that comprise at least one stably incorporated nucleotide construct comprising a coding sequence of the embodiments operably linked to a promoter that drives expression of the encoded pesticidal polypeptide. Accordingly, transformed plant cells, plant tissues, plants, and seeds thereof are also provided.

In another aspect transformed plants can be produced using a nucleic acid that has been optimized for increased expression in a host plant. For example, one of the pesticidal polypeptides of the embodiments can be back-translated to produce a nucleic acid comprising codons optimized for expression in a particular host, for example a crop plant such as a corn (Zea mays) plant. Expression of a coding sequence by such a transformed plant (e.g., dicot or monocot) will result in the production of a pesticidal polypeptide and confer increased insect resistance to the plant. Some embodiments provide transgenic plants expressing pesticidal polypeptides that find use in methods for impacting various insect pests.

In another aspect, pesticidal or insecticidal compositions containing the variant Cry1B polypeptides of the embodiments are provided and the composition can optionally comprise further insecticidal peptides. The embodiments encompass the application of such compositions to the environment of insect pests in order to impact the insect pests.

BRIEF DESCRIPTION OF THE FIGURES

FIG. 1A-1G shows an amino acid sequence alignment, using the ALIGNX® module of the Vector NTI® suite, of Cry1Bd (SEQ ID NO: 1), IP1B-B1 (SEQ ID NO: 3), IP1B-B21 (SEQ ID NO: 5), IP1B-B22 (SEQ ID NO: 7), IP1B-B23 (SEQ ID NO: 9), IP1B-B24 (SEQ ID NO: 11), IP1B-B25 (SEQ ID NO: 13), IP1B-B26 (SEQ ID NO: 15), IP1B-B27 (SEQ ID NO: 17), IP1B-B28 (SEQ ID NO: 19), IP1B-B29 (SEQ ID NO: 21), IP1B-B31 (SEQ ID NO: 23), IP1B-B32 (SEQ ID NO: 25), IP1B-B33 (SEQ ID NO: 27), IP1B-B34 (SEQ ID NO: 29), IP1B-B40 (SEQ ID NO: 31), IP1B-B41 (SEQ ID NO: 33), IP1B-B42 (SEQ ID NO: 35), IP1B-B43 (SEQ ID NO: 37), IP1B-B44 (SEQ ID NO: 39), IP1B-B45 (SEQ ID NO: 41), IP1B-B46 (SEQ ID NO: 43), IP1B-B47 (SEQ ID NO: 45), MP258 (SEQ ID NO: 47), and GS060 (SEQ ID NO: 49). The amino acid sequence diversity between the Cry1B polypeptides is highlighted.

FIG. 2A-2E shows the amino acid sequence of MP258 (SEQ ID NO; 47) with the leader region (*), Domain I (#), Domain II (&), and Domain III (!) indicated below the sequence.

FIG. 3 shows an amino acid sequence alignment, using the ALIGNX® module of the Vector NTI® suite, of the Cry1Be type Domain I of Cry1Be (amino acids 35-276 of SEQ ID NO: 58) and the Cry1Be type Domain I of MP258 (amino acids 36-276 of SEQ ID NO: 47). The amino acid sequence diversity between Domains I of the Cry1B polypeptides is highlighted.

FIG. 4 shows an amino acid sequence alignment, using the ALIGNX® module of the Vector NTI® suite, of Domain III of Cry1Ah (amino acids 483-643 of SEQ ID NO: 61), Cry1Bd (amino acids 490-651 of SEQ ID NO: 1), Cry1Bh (amino acids 494-655 of SEQ ID NO: 52), Cry1Bi (amino acids 502-663 of SEQ ID NO: 54), and MP258 (amino acids 494-655 of SEQ ID NO: 47). The amino acid sequence diversity between Domain III the Cry1B polypeptides is highlighted.

FIG. 5A-5C shows an amino acid sequence alignment, using the ALIGNX® module of the Vector NTI® suite, of Domain I and Domain II of MP258 (amino acids 35-494 of SEQ ID NO: 47), Cry1Be (amino acids 35-494 of SEQ ID NO: 58), Cry1Bi (amino acids 42-502 of SEQ ID NO: 54), Cry1Bg (amino acids 42-502 of SEQ ID NO: 60), Cry1Bf (amino acids 35-495 of SEQ ID NO: 59), Cry1Ba (amino acids 30-490 of SEQ ID NO: 55), Cry1Bh (amino acids 35-494 of SEQ ID NO: 52), Cry1Bd (amino acids 35-495 of SEQ ID NO: 1), Cry1Bb (amino acids 35-496 of SEQ ID NO: 56), and Cry1Bc (amino acids 35-496 of SEQ ID NO: 57). The amino acid sequence diversity between Domain I and Domain II of the Cry1B polypeptides is highlighted.

FIG. 6A-6G shows an amino acid sequence alignment, using the ALIGNX® module of the Vector NTI® suite, of the variant Cry1B polypeptides IP1B-B60 (SEQ ID NO: 62), IP1B-B61 (SEQ ID NO: 63), IP1B-B62 (SEQ ID NO: 64), IP1B-B63 (SEQ ID NO: 65), IP1B-B64 (SEQ ID NO: 66), IP1B-B65 (SEQ ID NO: 67), IP1B-B66 (SEQ ID NO: 68), IP1B-B67 (SEQ ID NO: 69), IP1B-B68 (SEQ ID NO: 70), IP1B-B69 (SEQ ID NO: 71), IP1B-B80 (SEQ ID NO: 72), IP1B-B81 (SEQ ID NO: 73), IP1B-B82 (SEQ ID NO: 74), IP1B-B83 (SEQ ID NO: 75), IP1B-B100 (SEQ ID NO: 76), IP1B-B101 (SEQ ID NO: 77), and IP1B-B102 (SEQ ID NO: 78). The amino acid sequence diversity between the Cry1B polypeptides is highlighted.

FIG. 7A-7B shows an amino acid sequence alignment, using the ALIGNX® module of the Vector NTI® suite, of Cry1Bd (SEQ ID NO: 1), MP258 (SEQ ID NO: 47), and the Cry1Bd/MP258 chimeras MO2-01 (SEQ ID NO: 145) and MO2-02 (SEQ ID NO: 146).

FIG. 8 shows an amino acid sequence alignment, using the ALIGNX® module of the Vector NTI® suite, of amino acids 101-250 of Cry1Bd (SEQ ID NO: 1) and amino acids 101-250 of each of the Cry1Bd/MP258 Domain I alpha-helices chimera polypeptides MO5-01 (amino acids 101-250 of SEQ ID NO: 148), MO5-02 (amino acids 101-250 of SEQ ID NO: 155), MO5-03 (amino acids 101-250 of SEQ ID NO: 156), MO5-04 (amino acids 101-250 of SEQ ID NO: 157), MO5-05 (amino acids 101-250 of SEQ ID NO: 158), MO5-06 (amino acids 101-250 of SEQ ID NO: 159), and MO5-07 (amino acids 101-250 of SEQ ID NO: 160). The amino acid differences between amino acids 101-250 of Cry1Bd (SEQ ID NO: 1) and amino acids 101-250 of the Cry1Bd/MP258 Domain I alpha-helices chimeras are highlighted.

FIG. 9 shows an amino acid sequence alignment, using the ALIGNX® module of the Vector NTI® suite, of amino acids 101-250 of MP258 (SEQ ID NO: 47) and amino acids 101-250 of the Cry1Bd/MP258 Domain I alpha-helices chimera polypeptides MO4-01 (amino acids 101-250 of SEQ ID NO: 147), MO4-02 (amino acids 101-250 of SEQ ID NO: 148), MO4-03 (amino acids 101-250 of SEQ ID NO: 149), MO4-04 (amino acids 101-250 of SEQ ID NO: 150), MO4-05 (amino acids 101-250 of SEQ ID NO: 151), MO4-06 (amino acids 101-250 of SEQ ID NO: 152), and MO4-07 (amino acids 101-250 of SEQ ID NO: 153). The amino acid differences between amino acids 101-250 of MP258 (amino acids 101-250 of SEQ ID NO: 1) and amino acids 101-250 of the Cry1Bd/MP258 Domain I alpha-helices chimeras are highlighted.

DETAILED DESCRIPTION

The embodiments of the disclosure are drawn to compositions and methods for impacting insect pests, particularly plant pests. More specifically, the isolated nucleic acid of the embodiments, and fragments and variants thereof, comprise nucleotide sequences that encode pesticidal polypeptides (e.g., proteins). The disclosed pesticidal proteins are biologically active (e.g., pesticidal) against insect pests such as, but not limited to, insect pests of the order Lepidoptera and/or Coleoptera.

The compositions of the embodiments comprise isolated nucleic acids, and fragments and variants thereof, which encode pesticidal polypeptides, expression cassettes comprising nucleotide sequences of the embodiments, isolated pesticidal proteins, and pesticidal compositions. Some embodiments provide modified pesticidal polypeptides having improved insecticidal activity against Lepidopterans relative to the pesticidal activity of the corresponding wild-type protein. The embodiments further provide plants and microorganisms transformed with these novel nucleic acids, and methods involving the use of such nucleic acids, pesticidal compositions, transformed organisms, and products thereof in impacting insect pests.

The nucleic acids and nucleotide sequences of the embodiments may be used to transform any organism to produce the encoded pesticidal proteins. Methods are provided that involve the use of such transformed organisms to impact or control plant pests. The nucleic acids and nucleotide sequences of the embodiments may also be used to transform organelles such as chloroplasts (McBride et al. (1995) *Biotechnology* 13: 362-365; and Kota et al. (1999) *Proc. Natl. Acad. Sci. USA* 96: 1840-1845).

The embodiments further relate to the identification of fragments and variants of the naturally-occurring coding sequence that encode biologically active pesticidal proteins. The nucleotide sequences of the embodiments find direct use in methods for impacting pests, particularly insect pests such as pests of the order Lepidoptera. Accordingly, the embodiments provide new approaches for impacting insect pests that do not depend on the use of traditional, synthetic chemical insecticides. The embodiments involve the discovery of naturally-occurring, biodegradable pesticides and the genes that encode them.

The embodiments further provide fragments and variants of the naturally occurring coding sequence that also encode biologically active (e.g., pesticidal) polypeptides. The nucleic acids of the embodiments encompass nucleic acid or nucleotide sequences that have been optimized for expression by the cells of a particular organism, for example nucleic acid sequences that have been back-translated (i.e., reverse translated) using plant-preferred codons based on the amino acid sequence of a polypeptide having enhanced pesticidal activity. The embodiments further provide mutations which confer improved or altered properties on the polypeptides of the embodiments. See, e.g. U.S. Pat. No. 7,462,760.

In the description that follows, a number of terms are used extensively. The following definitions are provided to facilitate understanding of the embodiments.

Units, prefixes, and symbols may be denoted in their SI accepted form. Unless otherwise indicated, nucleic acids are written left to right in 5' to 3' orientation; amino acid sequences are written left to right in amino to carboxy orientation, respectively. Numeric ranges are inclusive of the numbers defining the range. Amino acids may be referred to herein by either their commonly known three letter symbols or by the one-letter symbols recommended by the IUPAC-IUB Biochemical Nomenclature Commission. Nucleotides, likewise, may be referred to by their commonly accepted single-letter codes. The above-defined terms are more fully defined by reference to the specification as a whole.

As used herein, "nucleic acid" includes reference to a deoxyribonucleotide or ribonucleotide polymer in either single- or double-stranded form, and unless otherwise limited, encompasses known analogues (e.g., peptide nucleic acids) having the essential nature of natural nucleotides in that they hybridize to single-stranded nucleic acids in a manner similar to that of naturally occurring nucleotides.

As used herein, the terms "encoding" or "encoded" when used in the context of a specified nucleic acid mean that the nucleic acid comprises the requisite information to direct translation of the nucleotide sequence into a specified protein. The information by which a protein is encoded is specified by the use of codons. A nucleic acid encoding a protein may comprise non-translated sequences (e.g., introns) within translated regions of the nucleic acid or may lack such intervening non-translated sequences (e.g., as in cDNA).

As used herein, "full-length sequence" in reference to a specified polynucleotide or its encoded protein means having the entire nucleic acid sequence or the entire amino acid sequence of a native (non-synthetic), endogenous sequence. A full-length polynucleotide encodes the full-length, catalytically active form of the specified protein.

As used herein, the term "antisense" used in the context of orientation of a nucleotide sequence refers to a duplex polynucleotide sequence that is operably linked to a promoter in an orientation where the antisense strand is transcribed. The antisense strand is sufficiently complementary to an endogenous transcription product such that translation of the endogenous transcription product is often inhibited. Thus, where the term "antisense" is used in the context of a particular nucleotide sequence, the term refers to the complementary strand of the reference transcription product.

The terms "polypeptide," "peptide," and "protein" are used interchangeably herein to refer to a polymer of amino acid residues. The terms apply to amino acid polymers in which one or more amino acid residues is an artificial chemical analogue of a corresponding naturally occurring amino acid, as well as to naturally occurring amino acid polymers.

The terms "residue" or "amino acid residue" or "amino acid" are used interchangeably herein to refer to an amino acid that is incorporated into a protein, polypeptide, or peptide (collectively "protein"). The amino acid may be a naturally occurring amino acid and, unless otherwise limited, may encompass known analogues of natural amino acids that can function in a similar manner as naturally occurring amino acids.

Polypeptides of the embodiments can be produced either from a nucleic acid disclosed herein, or by the use of standard molecular biology techniques. For example, a protein of the embodiments can be produced by expression of a recombinant nucleic acid of the embodiments in an appropriate host cell, or alternatively by a combination of ex vivo procedures.

As used herein, the terms "isolated" and "purified" are used interchangeably to refer to nucleic acids or polypeptides or biologically active portions thereof that are substantially or essentially free from components that normally accompany or interact with the nucleic acid or polypeptide as found in its naturally occurring environment. Thus, an isolated or purified nucleic acid or polypeptide is substantially free of other cellular material or culture medium when produced by recombinant techniques, or substantially free of chemical precursors or other chemicals when chemically synthesized.

An "isolated" nucleic acid is generally free of sequences (such as, for example, protein-encoding sequences) that naturally flank the nucleic acid (i.e., sequences located at the 5' and 3' ends of the nucleic acid) in the genomic DNA of the organism from which the nucleic acid is derived. For example, in various embodiments, the isolated nucleic acids can contain less than about 5 kb, 4 kb, 3 kb, 2 kb, 1 kb, 0.5 kb, or 0.1 kb of nucleotide sequences that naturally flank the nucleic acids in genomic DNA of the cell from which the nucleic acid is derived.

As used herein, the term "isolated" or "purified" as it is used to refer to a polypeptide of the embodiments means that the isolated protein is substantially free of cellular material and includes preparations of protein having less than about 30%, 20%, 10%, or 5% (by dry weight) of contaminating protein. When the protein of the embodiments or biologically active portion thereof is recombinantly produced, culture medium represents less than about 30%, 20%, 10%, or 5% (by dry weight) of chemical precursors or non-protein-of-interest chemicals.

A "recombinant" nucleic acid molecule (or DNA) is used herein to refer to a nucleic acid sequence (or DNA) that is in a recombinant bacterial or plant host cell. In some embodiments, an "isolated" or "recombinant" nucleic acid is free of sequences (preferably protein encoding sequences) that naturally flank the nucleic acid (i.e., sequences located at the 5' and 3' ends of the nucleic acid) in the genomic DNA of the organism from which the nucleic acid is derived. For purposes of the disclosure, "isolated" or "recombinant" when used to refer to nucleic acid molecules excludes isolated chromosomes.

As used herein a "non-genomic nucleic acid sequence" or "non-genomic nucleic acid molecule" refers to a nucleic acid molecule that has one or more change in the nucleic acid sequence compared to a native or genomic nucleic acid sequence. In some embodiments the change to a native or genomic nucleic acid molecule includes but is not limited to: changes in the nucleic acid sequence due to the degeneracy of the genetic code; codon optimization of the nucleic acid sequence for expression in plants; changes in the nucleic acid sequence to introduce at least one amino acid substitution, insertion, deletion and/or addition compared to the native or genomic sequence; removal of one or more intron associated with the genomic nucleic acid sequence; insertion of one or more heterologous introns; deletion of one or more upstream or downstream regulatory regions associated with the genomic nucleic acid sequence; insertion of one or more heterologous upstream or downstream regulatory regions; deletion of the 5' and/or 3' untranslated region associated with the genomic nucleic acid sequence; insertion of a heterologous 5' and/or 3' untranslated region; and modification of a polyadenylation site. In some embodiments the non-genomic nucleic acid molecule is a cDNA. In some embodiments the non-genomic nucleic acid molecule is a synthetic nucleic acid sequence.

Throughout the specification the word "comprising," or variations such as "comprises" or "comprising," will be understood to imply the inclusion of a stated element, integer or step, or group of elements, integers or steps, but not the exclusion of any other element, integer or step, or group of elements, integers or steps.

As used herein, the term "impacting insect pests" refers to effecting changes in insect feeding, growth, and/or behavior at any stage of development, including but not limited to: killing the insect; retarding growth; preventing reproductive capability; antifeedant activity; and the like.

As used herein, the terms "pesticidal activity" and "insecticidal activity" are used synonymously to refer to activity of an organism or a substance (such as, for example, a protein) that can be measured by, but is not limited to, pest mortality, pest weight loss, pest repellency, and other behavioral and physical changes of a pest after feeding and exposure for an appropriate length of time. Thus, an organism or substance having pesticidal activity adversely impacts at least one measurable parameter of pest fitness. For example, "pesticidal proteins" are proteins that display pesticidal activity by themselves or in combination with other proteins.

As used herein, the term "pesticidally effective amount" means a quantity of a substance or organism that has pesticidal activity when present in the environment of a pest. For each substance or organism, the pesticidally effective amount is determined empirically for each pest affected in a specific environment. Similarly, an "insecticidally effective amount" may be used to refer to a "pesticidally effective amount" when the pest is an insect pest.

As used herein, the term "recombinantly engineered" or "engineered" means the utilization of recombinant DNA technology to introduce (e.g., engineer) a change in the protein structure based on an understanding of the protein's structure and/or mechanism of action and a consideration of the amino acids being introduced, deleted, or substituted.

As used herein, the term "mutant nucleotide sequence" or "mutation" or "mutagenized nucleotide sequence" means a nucleotide sequence that has been mutagenized or altered to contain one or more nucleotide residues (e.g., base pair) that is not present in the corresponding wild-type sequence. Such mutagenesis or alteration consists of one or more additions, deletions, or substitutions or replacements of nucleic acid residues. When mutations are made by adding, removing, or replacing an amino acid of a proteolytic site, such addition, removal, or replacement may be within or adjacent to the proteolytic site motif, so long as the object of the mutation is accomplished (i.e., so long as proteolysis at the site is changed).

A mutant nucleotide sequence can encode a mutant insecticidal toxin showing improved or decreased insecticidal activity, or an amino acid sequence which confers improved or decreased insecticidal activity on a polypeptide containing it. As used herein, the term "mutant" or "mutation" in the context of a protein a polypeptide or amino acid sequence refers to a sequence which has been mutagenized or altered to contain one or more amino acid residues that are not present in the corresponding wild-type sequence.

Such mutagenesis or alteration consists of one or more additions, deletions, or substitutions or replacements of amino acid residues. A mutant polypeptide shows improved or decreased insecticidal activity, or represents an amino acid sequence which confers improved insecticidal activity on a polypeptide containing it. Thus, the term "mutant" or "mutation" refers to either or both of the mutant nucleotide sequence and the encoded amino acids. Mutants may be used alone or in any compatible combination with other mutants of the embodiments or with other mutants. A "mutant polypeptide" may conversely show a decrease in insecticidal activity. Where more than one mutation is added to a particular nucleic acid or protein, the mutations may be added at the same time or sequentially; if sequentially, mutations may be added in any suitable order.

As used herein, the term "improved insecticidal activity" or "improved pesticidal activity" refers to an insecticidal polypeptide of the embodiments that has enhanced insecticidal activity relative to the activity of its corresponding wild-type protein, and/or an insecticidal polypeptide that is effective against a broader range of insects, and/or an insecticidal polypeptide having specificity for an insect that is not susceptible to the toxicity of the wild-type protein. A finding of improved or enhanced pesticidal activity requires a demonstration of an increase of pesticidal activity of at least 10%, against the insect target, or at least 20%, 25%, 30%, 35%, 40%, 45%, 50%, 60%, 70%, 100%, 150%, 200%, or 300% or greater increase of pesticidal activity relative to the pesticidal activity of the wild-type insecticidal polypeptide determined against the same insect.

For example, an improved pesticidal or insecticidal activity is provided where a wider or narrower range of insects is impacted by the polypeptide relative to the range of insects that is affected by a wild-type Bt toxin. A wider range of impact may be desirable where versatility is desired, while a narrower range of impact may be desirable where, for example, beneficial insects might otherwise be impacted by use or presence of the toxin. While the embodiments are not bound by any particular mechanism of action, an improved pesticidal activity may also be provided by changes in one or more characteristics of a polypeptide; for example, the stability or longevity of a polypeptide in an insect gut may be increased relative to the stability or longevity of a corresponding wild-type protein.

The term "toxin" as used herein refers to a polypeptide showing pesticidal activity or insecticidal activity or improved pesticidal activity or improved insecticidal activity. "Bt" or "*Bacillus thuringiensis*" toxin is intended to include the broader class of Cry toxins found in various strains of Bt, which includes such toxins as, for example, Cry1s, Cry2s, or Cry3s.

The terms "proteolytic site" or "cleavage site" refer to an amino acid sequence which confers sensitivity to a class of proteases or a particular protease such that a polypeptide containing the amino acid sequence is digested by the class of proteases or particular protease. A proteolytic site is said to be "sensitive" to the protease(s) that recognize that site. It is appreciated in the art that the efficiency of digestion will vary, and that a decrease in efficiency of digestion can lead to an increase in stability or longevity of the polypeptide in an insect gut. Thus, a proteolytic site may confer sensitivity to more than one protease or class of proteases, but the efficiency of digestion at that site by various proteases may vary. Proteolytic sites include, for example, trypsin sites, chymotrypsin sites, and elastase sites.

Research has shown that the insect gut proteases of Lepidopterans include trypsins, chymotrypsins, and elastases. See, e.g., Lenz et al. (1991) *Arch. Insect Biochem. Physiol.* 16: 201-212; and Hedegus et al. (2003) *Arch. Insect Biochem. Physiol.* 53: 30-47. For example, about 18 different trypsins have been found in the midgut of *Helicoverpa armigera* larvae (see Gatehouse et al. (1997) *Insect Biochem. Mol. Biol.* 27: 929-944). The preferred proteolytic substrate sites of these proteases have been investigated. See, e.g., Peterson et al. (1995) *Insect Biochem. Mol. Biol.* 25: 765-774.

Efforts have been made to understand the mechanism of action of Bt toxins and to engineer toxins with improved properties. It has been shown that insect gut proteases can affect the impact of Bt Cry proteins on the insect. Some proteases activate the Cry proteins by processing them from a "protoxin" form into a toxic form, or "toxin." See, Oppert (1999) *Arch. Insect Biochem. Phys.* 42: 1-12; and Carroll et al. (1997) *J. Invertebrate Pathology* 70: 41-49. This activation of the toxin can include the removal of the N- and C-terminal peptides from the protein and can also include internal cleavage of the protein. Other proteases can degrade the Cry proteins. See Oppert, ibid.

A comparison of the amino acid sequences of Cry toxins of different specificities reveals five highly-conserved sequence blocks. Structurally, the toxins comprise three distinct Domains which are, from the N- to C-terminus: a cluster of seven alpha-helices implicated in pore formation (referred to as "Domain I"), three anti-parallel beta sheets implicated in cell binding (referred to as "Domain 2"), and a beta sandwich (referred to as "Domain 3"). The location and properties of these Domains are known to those of skill in the art. See, for example, Li et al. (1991) *Nature*, 305:815-821 and Morse et al. (2001) *Structure*, 9:409-417. When reference is made to a particular domain, such as Domain I, it is understood that the exact endpoints of the domain with regard to a particular sequence may vary so long as the sequence or portion thereof includes sequence that provides at least some function attributed to the particular domain. Thus, for example, when referring to "Domain I," it is intended that a particular sequence includes a cluster of seven alpha-helices, but the exact endpoints of the sequence used or referred to with regard to that cluster may vary. One of skill in the art is familiar with the determination of such endpoints and the evaluation of such functions.

In an effort to improve Cry2B toxins, an effort was undertaken to identify the nucleotide sequences encoding the crystal proteins from the selected strains, which had improved activity compared to the native toxin. Depending upon the characteristics of a given preparation, it was recognized that the demonstration of pesticidal activity sometimes required trypsin pretreatment to activate the pesticidal proteins. Thus, it is understood that some pesticidal proteins require protease digestion (e.g., by trypsin, chymotrypsin, and the like) for activation, while other proteins are biologically active (e.g., pesticidal) in the absence of activation.

Such molecules may be altered by means described, for example, U.S. Pat. No. 7,462,760. In addition, nucleic acid sequences may be engineered to encode polypeptides that contain additional mutations that confer improved or altered pesticidal activity relative to the pesticidal activity of the naturally occurring polypeptide. The nucleotide sequences of such engineered nucleic acids comprise mutations not found in the wild type sequences.

The mutant polypeptides of the embodiments are generally prepared by a process that involves the steps of: obtaining a nucleic acid sequence encoding a Cry family polypeptide; analyzing the structure of the polypeptide to identify particular "target" sites for mutagenesis of the underlying gene sequence based on a consideration of the proposed function of the target domain in the mode of action of the toxin; introducing one or more mutations into the nucleic acid sequence to produce a desired change in one or more amino acid residues of the encoded polypeptide sequence; and assaying the polypeptide produced for pesticidal activity.

Many of the Bt insecticidal toxins are related to various degrees by similarities in their amino acid sequences and tertiary structure and means for obtaining the crystal structures of Bt toxins are well known. Exemplary high-resolution crystal structure solution of both the Cry3A and Cry3B polypeptides are available in the literature. The solved structure of Cry3A (Li et al. (1991) Nature 353:815-821) provides insight into the relationship between structure and function of the toxin. A combined consideration of the published structural analyses of Bt toxins and the reported function associated with particular structures, motifs, and the like indicates that specific regions of the toxin are correlated with particular functions and discrete steps of the mode of action of the protein. For example, many toxins isolated from Bt are generally described as comprising three domains: a seven-helix bundle that is involved in pore formation, a three-sheet domain that has been implicated in receptor binding, and a beta-sandwich motif (Li et al. (1991) Nature 305: 815-821).

As reported in U.S. Pat. Nos. 7,105,332, and 7,462,760, the toxicity of Cry proteins can be improved by targeting the region located between alpha helices 3 and 4 of Domain I of the toxin. This theory was premised on a body of knowledge concerning insecticidal toxins, including: 1) that alpha helices 4 and 5 of Domain I of Cry3A toxins had been reported to insert into the lipid bilayer of cells lining the midgut of susceptible insects (Gazit et al. (1998) Proc. Natl. Acad. Sci. USA 95: 12289-12294); 2) the inventors' knowledge of the location of trypsin and chymotrypsin cleavage sites within the amino acid sequence of the wild-type protein; 3) the observation that the wild-type protein was more active against certain insects following in vitro activation by trypsin or chymotrypsin treatment; and 4) reports that digestion of toxins from the 3' end resulted in decreased toxicity to insects.

A series of mutations may be created and placed in a variety of background sequences to create novel polypeptides having enhanced or altered pesticidal activity. See, e.g., U.S. Pat. No. 7,462,760. These mutants include, but are not limited to: the addition of at least one more protease-sensitive site (e.g., trypsin cleavage site) in the region located between helices 3 and 4 of Domain I; the replacement of an original protease-sensitive site in the wild-type sequence with a different protease-sensitive site; the addition of multiple protease-sensitive sites in a particular location; the addition of amino acid residues near protease-sensitive site(s) to alter folding of the polypeptide and thus enhance digestion of the polypeptide at the protease-sensitive site(s); and adding mutations to protect the polypeptide from degradative digestion that reduces toxicity (e.g., making a series of mutations wherein the wild-type amino acid is replaced by valine to protect the polypeptide from digestion). Mutations may be used singly or in any combination to provide polypeptides of the embodiments.

Homologous sequences were identified by similarity search on the non-redundant database (nr) of National Center for Bioinformatics Information (NCBI) using BLAST and PSI-BLAST. The homologous proteins were made up of Cry toxins primarily from Bacillus thuringiensis.

A mutation which is an additional or alternative protease-sensitive site may be sensitive to several classes of proteases such as serine proteases, which include trypsin and chymotrypsin, or enzymes such as elastase. Thus, a mutation which is an additional or alternative protease-sensitive site may be designed so that the site is readily recognized and/or cleaved by a category of proteases, such as mammalian proteases or insect proteases. A protease-sensitive site may also be designed to be cleaved by a particular class of enzymes or a particular enzyme known to be produced in an organism, such as, for example, a chymotrypsin produced by the corn earworm Heliothis zea (Lenz et al. (1991) Arch. Insect Biochem. Physiol. 16: 201-212). Mutations may also confer resistance to proteolytic digestion, for example, to digestion by chymotrypsin at the C-terminus of the peptide.

The presence of an additional and/or alternative protease-sensitive site in the amino acid sequence of the encoded polypeptide can improve the pesticidal activity and/or specificity of the polypeptide encoded by the nucleic acids of the embodiments. Accordingly, the nucleotide sequences of the embodiments can be recombinantly engineered or manipulated to produce polypeptides having improved or altered insecticidal activity and/or specificity compared to that of an unmodified wild-type toxin. In addition, the mutations disclosed herein may be placed in or used in conjunction with other nucleotide sequences to provide improved properties. For example, a protease-sensitive site that is readily cleaved by insect chymotrypsin, e.g., a chymotrypsin found in the bertha armyworm or the corn earworm (Hegedus et al. (2003) Arch. Insect Biochem. Physiol. 53: 30-47; and Lenz et al. (1991) Arch. Insect Biochem. Physiol. 16: 201-212), may be placed in a Cry background sequence to provide improved toxicity to that sequence. In this manner, the embodiments provide toxic polypeptides with improved properties.

For example, a mutagenized Cry nucleotide sequence can comprise additional mutants that comprise additional codons that introduce a second trypsin-sensitive amino acid sequence (in addition to the naturally occurring trypsin site) into the encoded polypeptide. An alternative addition mutant of the embodiments comprises additional codons designed to introduce at least one additional different protease-sensitive site into the polypeptide; for example, a chymotrypsin-sensitive site located immediately 5' or 3' of the naturally occurring trypsin site. Alternatively, substitution mutants may be created in which at least one codon of the nucleic acid that encodes the naturally occurring protease-sensitive site is destroyed and alternative codons are introduced into the nucleic acid sequence in order to provide a different (e.g., substitute) protease-sensitive site. A replacement mutant may also be added to a Cry sequence in which the naturally-occurring trypsin cleavage site present in the encoded polypeptide is destroyed and a chymotrypsin or elastase cleavage site is introduced in its place.

It is recognized that any nucleotide sequence encoding the amino acid sequences that are proteolytic sites or putative proteolytic sites (for example, sequences such as RR, or LKM) can be used and that the exact identity of the codons used to introduce any of these cleavage sites into a variant polypeptide may vary depending on the use, i.e., expression in a particular plant species. It is also recognized that any of the disclosed mutations can be introduced into any polynucleotide sequence of the embodiments that comprises the codons for amino acid residues that provide the native trypsin cleavage site that is targeted for modification. Accordingly, variants of either full-length toxins or fragments thereof can be modified to contain additional or alternative cleavage sites, and these embodiments are intended to be encompassed by the scope of the embodiments disclosed herein.

It will be appreciated by those of skill in the art that any useful mutation may be added to the sequences of the embodiments so long as the encoded polypeptides retain pesticidal activity. Thus, sequences may also be mutated so that the encoded polypeptides are resistant to proteolytic digestion by chymotrypsin. More than one recognition site can be added in a particular location in any combination, and multiple recognition sites can be added to or removed from the toxin. Thus, additional mutations can comprise three, four, or more recognition sites. It is to be recognized that multiple mutations can be engineered in any suitable polynucleotide sequence; accordingly, either full-length sequences or fragments thereof can be modified to contain additional or alternative cleavage sites as well as to be resistant to proteolytic digestion. In this manner, the embodiments provide Cry toxins containing mutations that improve pesticidal activity as well as improved compositions and methods for impacting pests using other Bt toxins.

Mutations may protect the polypeptide from protease degradation, for example by removing putative proteolytic sites such as putative serine protease sites and elastase recognition sites from different areas. Some or all of such putative sites may be removed or altered so that proteolysis at the location of the original site is decreased. Changes in proteolysis may be assessed by comparing a mutant polypeptide with wild-type toxins or by comparing mutant toxins which differ in their amino acid sequence. Putative proteolytic sites and proteolytic sites include, but are not limited to, the following sequences: RR, a trypsin cleavage site; LKM, a chymotrypsin site; and a trypsin site. These sites may be altered by the addition or deletion of any number and kind of amino acid residues, so long as the pesticidal activity of the polypeptide is increased. Thus, polypeptides encoded by nucleotide sequences comprising mutations will comprise at least one amino acid change or addition relative to the native or background sequence, or 2, 3, 4, 5, 6, 7, 8, 9, 10, 11, 12, 13, 14, 15, 16, 17, 18, 19, 20, 21, 22, 23, 24, 25, 26, 27, 28, 29, 30, 32, 35, 38, 40, 45, 47, 50, 60, 70, 80, 90, 100, 110, 120, 130, 140, 150, 160, 170, 180, 190, 200, 210, 220, 230, 240, 250, 260, 270, or 280 or more amino acid changes or additions. Pesticidal activity of a polypeptide may also be improved by truncation of the native or full-length sequence, as is known in the art.

Compositions of the embodiments include nucleic acids, and fragments and variants thereof that encode pesticidal polypeptides. In particular, the embodiments provide for isolated nucleic acid molecules comprising nucleotide sequences encoding the polypeptide of SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43 and SEQ ID NO: 45, or the nucleotide sequences encoding said amino acid sequence, for example the nucleotide sequence set forth in SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44 or SEQ ID NO: 46, and fragments and variants thereof.

In particular, the embodiments provide for isolated nucleic acid molecules encoding the amino acid sequence shown in SEQ ID NO: 4 or SEQ ID NO: 8, or the nucleotide sequences encoding said amino acid sequence, for example the nucleotide sequence set forth in SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, and SEQ ID NO: 46, and fragments and variants thereof.

In some embodiments polynucleotides are provide encoding the polypeptide of SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78 or a variant thereof.

In some embodiments polynucleotides are provide encoding the polypeptide of SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144 or variants thereof.

Also of interest are optimized nucleotide sequences encoding the pesticidal proteins of the embodiments. As used herein, the phrase "optimized nucleotide sequences" refers to nucleic acids that are optimized for expression in a particular organism, for example a plant. Optimized nucleotide sequences may be prepared for any organism of interest using methods known in the art. See, for example, U.S. Pat. No. 7,462,760, which describes an optimized nucleotide sequence encoding a disclosed pesticidal protein. In this example, the nucleotide sequence was prepared by reverse-translating the amino acid sequence of the protein and changing the nucleotide sequence so as to comprise maize-preferred codons while still encoding the same amino acid sequence. This procedure is described in more detail by Murray et al. (1989) *Nucleic Acids Res.* 17:477-498. Optimized nucleotide sequences find use in increasing expression of a pesticidal protein in a plant, for example monocot plants of the Gramineae (Poaceae) family such as, for example, a maize or corn plant.

In some embodiments polypeptides are provided comprising an amino acid sequence set forth in SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43 or SEQ ID NO: 45 and fragments and variants thereof.

In some embodiments polypeptides are provided comprising an amino acid sequence set forth in SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 31, SEQ ID NO: 33, SEQ ID NO: 35, SEQ ID NO: 37, SEQ ID NO: 39, SEQ ID NO: 41, SEQ ID NO: 43 or SEQ ID NO: 45 and fragments and variants thereof.

In some embodiments polypeptides are provided comprising an amino acid sequence set forth in SEQ ID NO: 23, SEQ ID NO: 25, SEQ ID NO: 27 or SEQ ID NO: 29, and fragments and variants thereof.

In some embodiments polypeptides are provided comprising an amino acid sequence having at least 80% sequence identity to SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77 or SEQ ID NO: 78, and fragments and variants thereof.

In some embodiments polypeptides are provided comprising an amino acid sequence having at least 80% sequence identity to SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143 or SEQ ID NO: 144, and fragments and variants thereof.

In some embodiments polypeptides are provided comprising the amino acid sequence set forth in SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77 or SEQ ID NO: 78, and fragments and variants thereof.

In some embodiments polypeptides are provided comprising the amino acid sequence set forth in SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143 or SEQ ID NO: 144, and fragments and variants thereof.

In some embodiments variant Cry1B polypeptides having an amino acid substitution compared to the corresponding reference Cry1B polypeptide are provides that have increased insecticidal activity against corn earworm and/or fall armyworm compared to the "corresponding reference Cry1B polypeptide". By "corresponding reference Cry1B polypeptide" is meant a wild type or native Cry1B polypeptide or variant Cry1B polypeptide of the present embodiments, which can serve as the amino acid sequence that is mutagenized to create variant Cry1B polypeptide. In some embodiments the corresponding reference Cry1B polypeptide comprises a Cry1Be type Domain I and a Cry1Ah type Domain III. By "Cry1Be type Domain I" is meant an amino acid sequence having at least 90%, at least 91%, at least 92% at least 93% at least 94%, at least 95% at least 96%, at least 97%, at least 98%, at least 99% or greater sequence identity to amino acids 36-276 of SEQ ID NO: 58 (Cry1Be) or amino acids 35-276 of SEQ ID NO: 47. An amino acid sequence alignment of Domain I of Cry1Be (SEQ ID NO: 58) and MP258 (SEQ ID NO: 47) is shown in FIG. 3. Similarly, other native Cry1B polypeptides can be aligned with Cry1Be (SEQ ID NO: 58) and MP258 (SEQ ID NO: 47) to identify other Cry1Be type Domain I regions. By "Cry1Ah type Domain III" is meant an amino acid sequence having at least 80%, at least 81%, at least 82%, at least 83%, at least 84%, at least 85%, at least 86%, at least 87%, at least 88%, at least 89%, at least 90%, at least 91%, at least 92% at least 93% at least 94%, at least 95% at least 96%, at least 97%, at least 98%, at least 99% or greater sequence identity to amino acids 483-643 of SEQ ID NO: 61 (Cry1Ah) or 494-655 of SEQ ID NO: 47. An amino acid sequence alignment of Domain III of Cry1Ah (SEQ ID NO: 61), Cry1Bd (SEQ ID NO: 1), Cry1Bh (SEQ ID NO: 52), Cry1Bi (SEQ ID NO: 54), and MP258 (SEQ ID NO: 47) is shown in FIG. 4. Similarly, other native Cry1B polypeptides can be aligned with Cry1Ah (SEQ ID NO: 61), Cry1Bd, Cry1Bh (SEQ ID NO: 52), Cry1Bi (SEQ ID NO: 54), and/or MP258 (SEQ ID NO: 47) to identify other Cry1Ah type Domain III regions. In some embodiments the corresponding reference Cry1B polypeptide comprises a Cry1Ba type Domain I and Domain II. By "Cry1Ba type Domain I and Domain II" is meant an amino acid sequence having at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92% at least 93% at least 94%, at least 95% at least 96%, at least 97%, at least 98%, at least 99% or greater sequence identity to amino acids 30-489 of SEQ ID NO: 55 (Cry1Ba). An amino acid sequence alignment of Domain I and Domain II of MP258 (SEQ ID NO: 47), Cry1Be (SEQ ID NO: 58), Cry1Bi (SEQ ID NO: 54), Cry1Bg (SEQ ID NO: 60), Cry1Bf (SEQ ID NO: 59), Cry1Ba (SEQ ID NO: 55), Cry1Bh (SEQ ID NO: 52), Cry1Bd (SEQ ID NO: 1), Cry1Bb (SEQ ID NO: 56), and Cry1Bc (SEQ ID NO: 57) is shown in FIG. 5. Similarly, other native Cry1B polypeptides can be aligned with Cry1Ba (SEQ ID NO: 55) and MP258 (SEQ ID NO: 47) to identify other Cry1Ba type Domain I and Domain II regions.

In some embodiments the corresponding reference Cry1B polypeptide comprises a Cry1Be type Domain I and Domain II. By "Cry1Be type Domain I and Domain II" is meant an amino acid sequence having at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92% at least 93% at least 94%, at least 95% at least 96%, at least 97%, at least 98%, at least 99% or greater sequence identity to amino acids 35-494 of SEQ ID NO: 58 (Cry1Be) or amino acids 35-493 of SEQ ID NO: 47. An amino acid sequence alignment of Domain I and Domain II of MP258 (SEQ ID NO: 47), Cry1Be (SEQ ID NO: 58), Cry1Bi (SEQ ID NO: 54), Cry1Bg (SEQ ID NO: 60), Cry1Bf (SEQ ID NO: 59), Cry1Ba (SEQ ID NO: 55), Cry1Bh (SEQ ID NO: 52), Cry1Bd (SEQ ID NO: 1), Cry1Bb (SEQ ID NO: 56), and Cry1Bc (SEQ ID NO: 57) is shown in FIG. 5. Similarly, other native Cry1B polypeptides can be aligned with Cry1Be (SEQ ID NO: 58) and MP258 (SEQ ID NO: 47) to identify other Cry1Be type Domain I and Domain II regions.

By "improved activity" or "increased activity" is intended an increase of at least about 10%, at least about 15%, at least about 20%, at least about 25%, at least about 30%, at least about 35%, at least about 40%, at least about 50%, at least about 60%, at least about 70%, at least about 80%, at least about 90%, at least about 100%, at least about 110%, at least about 120%, at least about 130%, at least about 140%, at least about 150%, at least about 160%, at least about 170%, at least about 180%, at least about 190%, at least about 200%, at least about 210% at least about 220%, at least about 230%, at least about 240%, at least about 250%, at least about 260%, at least about 270%, at least about 280%, at least about 290%, at least about 300%, at least about 310%, at least about 320%, at least about 330%, at least about 340%, at least about 350%, at least about 360%, at least about 370%, at least about 380%, at least about 390%, at least about 400%, at least about 410%, at least about 420%, at least about 430%, at least about 440%, at least about 450%, at least about 460%, at least about 470%, at least about 480%, at least about 490%, at least about 500%, at least about 510%, at least about 520%, at least about 530%, at least about 540%, at least about 550%, at least about 560%, at least about 570%, at least about 580%, at least about 590%, at least about 600%, at least about 650%, at least about 700%, at least about 750%, at least about 800%, at least about 850%, at least about 900%, at least about 950%, at least about 1000% or higher or at least about 1-fold, at least about 1.5-fold, at least about 2-fold, at least about 2.5-fold, at least about 3-fold, at least about 3.5-fold, at least about 4-fold, at least about 4.5-fold, at least about 5-fold, at least about 5.5-fold, at least about 6-fold, at least about 6.5-fold, at least about 7-fold, at least about 7.5-fold, at least about 8-fold, at least about 8.5-fold, at least about 9-fold, at least about 9.5-fold, at least about 10-fold, at least about 15-fold, at least about 20-fold, at least about 25-fold, at least about 30-fold, at least about 35-fold, at least about 40-fold, at least about 45-fold, at least about 50-fold, at least about 55-fold, at least about 60-fold, at least about 65-fold, at least about 70-fold, at least about 75-fold, at least about 80-fold, at least about 85-fold, at least about 90-fold, at least about 95-fold, at least about 100-fold, at least about 110-fold, at least about 120-fold, at least about 130-fold, at least about 140-fold, at least about 150-fold, at least about 160-fold, at least about 170-fold, at least about 180-fold, at least about 190-fold, at least about 200-fold, at least about 210-fold, at least about 220-fold, at least about 230-fold, at least about 240-fold, at least about 250-fold, at least about 260-fold, at least about 270-fold, at least about 280-fold, at least about 290-fold, at least about 300-fold, at least about 350-fold, at least about 400-fold, at least about 450-fold, at least about 500-fold, at least about 550-fold, at least about 600-fold, at least about 650-fold, at least about 700-fold or higher increase in the pesticidal activity of the variant protein compared to the activity of the corresponding reference Cry1B polypeptide.

In some embodiments, the improvement consists of a decrease in the IC50 of at least about 10%, at least about 15%, at least about 20%, at least about 25%, at least about 30%, at least about 35%, at least about 40%, at least about 50%, at least about 60%, at least about 70%, at least about 80%, at least about 90%, at least about 100%, at least about 110%, at least about 120%, at least about 130%, at least about 140%, at least about 150%, at least about 160%, at least about 170%, at least about 180%, at least about 190%, at least about 200%, at least about 210% at least about 220%, at least about 230%, at least about 240%, at least about 250%, at least about 260%, at least about 270%, at least about 280%, at least about 290%, at least about 300%, at least about 310%, at least about 320%, at least about 330%, at least about 340%, at least about 350%, at least about 360%, at least about 370%, at least about 380%, at least about 390%, at least about 400%, at least about 410%, at least about 420%, at least about 430%, at least about 440%, at least about 450%, at least about 460%, at least about 470%, at least about 480%, at least about 490%, at least about 500%, at least about 510%, at least about 520%, at least about 530%, at least about 540%, at least about 550%, at least about 560%, at least about 570%, at least about 580%, at least about 590%, at least about 600%, at least about 650%, at least about 700%, at least about 750%, at least about 800%, at least about 850%, at least about 900%, at least about 950%, at least about 1000% or higher or at least about 1-fold, at least about 1.5-fold, at least about 2-fold, at least about 2.5-fold, at least about 3-fold, at least about 3.5-fold, at least about 4-fold, at least about 4.5-fold, at least about 5-fold, at least about 5.5-fold, at least about 6-fold, at least about 6.5-fold, at least about 7-fold, at least about 7.5-fold, at least about 8-fold, at least about 8.5-fold, at least about 9-fold, at least about 9.5-fold, at least about 10-fold, at least about 15-fold, at least about 20-fold, at least about 25-fold, at least about 30-fold, at least about 35-fold, at least about 40-fold, at least about 45-fold, at least about 50-fold, at least about 55-fold, at least about 60-fold, at least about 65-fold, at least about 70-fold, at least about 75-fold, at least about 80-fold, at least about 85-fold, at least about 90-fold, at least about 95-fold, at least about 100-fold, at least about 110-fold, at least about 120-fold, at least about 130-fold, at least about 140-fold, at least about 150-fold, at least about 160-fold, at least about 170-fold, at least about 180-fold, at least about 190-fold, at least about 200-fold, at least about 210-fold, at least about 220-fold, at least about 230-fold, at least about 240-fold, at least about 250-fold, at least about 260-fold, at least about 270-fold, at least about 280-fold, at least about 290-fold, at least about 300-fold, at least about 350-fold, at least about 400-fold, at least about 450-fold, at least about 500-fold, at least about 550-fold, at least about 600-fold, at least about 650-fold, at least about 700-fold or greater reduction in the IC50 of the variant Cry1B polypeptide relative to the pesticidal activity of the corresponding reference Cry1B polypeptide.

In some embodiments the IC50 of the variant Cry1B polypeptide is <100 ppm, <90 ppm, <80 ppm, <70 ppm, <60 ppm, <50 ppm, <45 ppm, <40 ppm, <35 ppm, <30 ppm, <25 ppm, <20 ppm, <19 ppm, <18 ppm, <17 ppm, <16 ppm, <15 ppm, <14 ppm, <13 ppm, <12 ppm, <11 ppm, <10 ppm, <9 ppm, <8 ppm, <7 ppm, <6 ppm, <5 ppm, <4 ppm, <3 ppm, <2 ppm, <1 ppm, <0.9 ppm, <0.8 ppm, <0.7 ppm, <0.6 ppm, <0.5 ppm, <0.4 ppm, <0.3 ppm, <0.2 ppm or <0.1 ppm.

In some embodiments, the improvement consists of an increase in the Mean FAE Index of at least about 10%, at least about 15%, at least about 20%, at least about 25%, at least about 30%, at least about 35%, at least about 40%, at least about 50%, at least about 60%, at least about 70%, at least about 80%, at least about 90%, at least about 100%, at least about 110%, at least about 120%, at least about 130%, at least about 140%, at least about 150%, at least about 160%, at least about 170%, at least about 180%, at least about 190%, at least about 200%, at least about 210% at least about 220%, at least about 230%, at least about 240%, at least about 250%, at least about 260%, at least about 270%, at least about 280%, at least about 290%, at least about 300%, at least about 310%, at least about 320%, at least about 330%, at least about 340%, at least about 350%, at least about 360%, at least about 370%, at least about 380%, at least about 390%, at least about 400%, at least about 410%, at least about 420%, at least about 430%, at least about 440%, at least about 450%, at least about 460%, at least about 470%, at least about 480%, at least about 490%, at least about 500%, at least about 510%, at least about 520%, at least about 530%, at least about 540%, at least about 550%, at least about 560%, at least about 570%, at least about 580%, at least about 590%, at least about 600%, at least about 650%, at least about 700%, at least about 750%, at least about 800%, at least about 850%, at least about 900%, at least about 950%, at least about 1000% or higher or at least about 1-fold, at least about 1.5-fold, at least about 2-fold, at least about 2.5-fold, at least about 3-fold, at least about 3.5-fold, at least about 4-fold, at least about 4.5-fold, at least about 5-fold, at least about 5.5-fold, at least about 6-fold, at least about 6.5-fold, at least about 7-fold, at least about 7.5-fold, at least about 8-fold, at least about 8.5-fold, at least about 9-fold, at least about 9.5-fold, at least about 10-fold, at least about 15-fold, at least about 20-fold, at least about 25-fold, at least about 30-fold, at least about 35-fold, at least about 40-fold, at least about 45-fold, at least about 50-fold, at least about 55-fold, at least about 60-fold, at least about 65-fold, at least about 70-fold, at least about 75-fold, at least about 80-fold, at least about 85-fold, at least about 90-fold, at least about 95-fold, at least about 100-fold, at least about 110-fold, at least about 120-fold, at least about 130-fold, at least about 140-fold, at least about 150-fold, at least about 160-fold, at least about 170-fold, at least about 180-fold, at least about 190-fold, at least about 200-fold, at least about 210-fold, at least about 220-fold, at least about 230-fold, at least about 240-fold, at least about 250-fold, at least about 260-fold, at least about 270-fold, at least about 280-fold, at least about 290-fold, at least about 300-fold, at least about 350-fold, at least about 400-fold, at least about 450-fold, at least about 500-fold, at least about 550-fold, at least about 600-fold, at least about 650-fold, at least about 700-fold or higher increase in the Mean FAE Index of the variant Cry1B polypeptide relative to the pesticidal activity of the corresponding reference Cry1B polypeptide.

"Mean FAE Index" (MFI) refers to the mean of multiple FAEGN an arithmetic mean of FAEGN. As used herein, the "Mean Deviation Score" refers to the arithmetic mean of multiple Deviation Scores.

In some embodiments, the improvement consists of an increase in the Mean Deviation Score of at least about 10%, at least about 15%, at least about 20%, at least about 25%, at least about 30%, at least about 35%, at least about 40%, at least about 50%, at least about 60%, at least about 70%, at least about 80%, at least about 90%, at least about 100%, at least about 110%, at least about 120%, at least about 130%, at least about 140%, at least about 150%, at least about 160%, at least about 170%, at least about 180%, at least about 190%, at least about 200%, at least about 210% at least about 220%, at least about 230%, at least about 240%, at least about 250%, at least about 260%, at least about 270%, at least about 280%, at least about 290%, at least about 300%, at least about 310%, at least about 320%, at least about 330%, at least about 340%, at least about 350%, at least about 360%, at least about 370%, at least about 380%, at least about 390%, at least about 400%, at least about 410%, at least about 420%, at least about 430%, at least about 440%, at least about 450%, at least about 460%, at least about 470%, at least about 480%, at least about 490%, at least about 500%, at least about 510%, at least about 520%, at least about 530%, at least about 540%, at least about 550%, at least about 560%, at least about 570%, at least about 580%, at least about 590%, at least about 600%, at least about 650%, at least about 700%, at least about 750%, at least about 800%, at least about 850%, at least about 900%, at least about 950%, at least about 1000% or higher or at least about 1-fold, at least about 1.5-fold, at least about 2-fold, at least about 2.5-fold, at least about 3-fold, at least about 3.5-fold, at least about 4-fold, at least about 4.5-fold, at least about 5-fold, at least about 5.5-fold, at least about 6-fold, at least about 6.5-fold, at least about 7-fold, at least about 7.5-fold, at least about 8-fold, at least about 8.5-fold, at least about 9-fold, at least about 9.5-fold, at least about 10-fold, at least about 15-fold, at least about 20-fold, at least about 25-fold, at least about 30-fold, at least about 35-fold, at least about 40-fold, at least about 45-fold, at least about 50-fold, at least about 55-fold, at least about 60-fold, at least about 65-fold, at least about 70-fold, at least about 75-fold, at least about 80-fold, at least about 85-fold, at least about 90-fold, at least about 95-fold, at least about 100-fold, at least about 110-fold, at least about 120-fold, at least about 130-fold, at least about 140-fold, at least about 150-fold, at least about 160-fold, at least about 170-fold, at least about 180-fold, at least about 190-fold, at least about 200-fold, at least about 210-fold, at least about 220-fold, at least about 230-fold, at least about 240-fold, at least about 250-fold, at least about 260-fold, at least about 270-fold, at least about 280-fold, at least about 290-fold, at least about 300-fold, at least about 350-fold, at least about 400-fold, at least about 450-fold, at least about 500-fold, at least about 550-fold, at least about 600-fold, at least about 650-fold, at least about 700-fold or higher increase in the Mean Deviation Score of the variant Cry1B polypeptide relative to the pesticidal activity of the corresponding reference Cry1B polypeptide.

In some embodiments the improved activity of the variant Cry1B polypeptide is relative to the pesticidal activity of SEQ ID NO: 1 (Cry1Bd), SEQ ID NO: 47 (MP258), SEQ ID NO: 52 (Cry1Bh), SEQ ID NO: 54 (Cry1Bi), SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 31, SEQ ID NO: 33, SEQ ID NO: 35, SEQ ID NO: 37, SEQ ID NO: 39, SEQ ID NO: 41, SEQ ID NO: 43 or SEQ ID NO: 45.

In particular embodiments, pesticidal proteins of the embodiments provide full-length insecticidal polypeptides, fragments of full-length insecticidal polypeptides, and variant polypeptides that are produced from mutagenized nucleic acids designed to introduce particular amino acid sequences into polypeptides of the embodiments. In particular embodiments, the amino acid sequences that are introduced into the polypeptides comprise a sequence that provides a cleavage site for an enzyme such as a protease.

It is known in the art that the pesticidal activity of Bt toxins is typically activated by cleavage of the peptide in the insect gut by various proteases. Because peptides may not always be cleaved with complete efficiency in the insect gut, fragments of a full-length toxin may have enhanced pesticidal activity in comparison to the full-length toxin itself. Thus, some of the polypeptides of the embodiments include fragments of a full-length insecticidal polypeptide, and some of the polypeptide fragments, variants, and mutations will have enhanced pesticidal activity relative to the activity of the naturally occurring insecticidal polypeptide from which they are derived, particularly if the naturally occurring insecticidal polypeptide is not activated in vitro with a protease prior to screening for activity. Thus, the present application encompasses truncated versions or fragments of the sequences.

Mutations may be placed into any background sequence, including such truncated polypeptides, so long as the polypeptide retains pesticidal activity. One of skill in the art can readily compare two or more proteins with regard to pesticidal activity using assays known in the art or described elsewhere herein. It is to be understood that the polypeptides of the embodiments can be produced either by expression of a nucleic acid disclosed herein, or by the use of standard molecular biology techniques.

It is recognized that the pesticidal proteins may be oligomeric and will vary in molecular weight, number of residues, component peptides, activity against particular pests, and other characteristics. However, by the methods set forth herein, proteins active against a variety of pests may be isolated and characterized. The pesticidal proteins of the embodiments can be used in combination with other Bt toxins or other insecticidal proteins to increase insect target range. Furthermore, the use of the pesticidal proteins of the embodiments in combination with other Bt toxins or other insecticidal principles of a distinct nature has particular utility for the prevention and/or management of insect resistance. Other insecticidal agents include protease inhibitors (both serine and cysteine types), α-amylase, and peroxidase.

Fragments and variants of the nucleotide and amino acid sequences and the polypeptides encoded thereby are also encompassed by the embodiments. As used herein the term "fragment" refers to a portion of a nucleotide sequence of a polynucleotide or a portion of an amino acid sequence of a polypeptide of the embodiments. Fragments of a nucleotide sequence may encode protein fragments that retain the biological activity of the native or corresponding full-length protein and hence possess pesticidal activity. Thus, it is acknowledged that some of the polynucleotide and amino acid sequences of the embodiments can correctly be referred to as both fragments and mutants.

It is to be understood that the term "fragment," as it is used to refer to nucleic acid sequences of the embodiments, also encompasses sequences that are useful as hybridization probes. This class of nucleotide sequences generally does not encode fragment proteins retaining biological activity. Thus, fragments of a nucleotide sequence may range from at least about 20 nucleotides, about 50 nucleotides, about 100 nucleotides, and up to the full-length nucleotide sequence encoding the proteins of the embodiments.

A fragment of a nucleotide sequence of the embodiments that encodes a biologically active portion of a pesticidal protein of the embodiments will encode at least 15, 25, 30, 50, 100, 200, 250 or 300 contiguous amino acids, or up to the total number of amino acids present in a pesticidal polypeptide of the embodiments (for example, 651 amino acids for SEQ ID NO: 3). Thus, it is understood that the embodiments also encompass polypeptides that are fragments of the exemplary pesticidal proteins of the embodiments and having lengths of at least 15, 25, 30, 50, 100, 200, 250 or 300 contiguous amino acids, or up to the total number of amino acids present in a pesticidal polypeptide of the embodiments (for example, 651 amino acids for SEQ ID NO: 3). Fragments of a nucleotide sequence of the embodiments that are useful as hybridization probes or PCR primers generally need not encode a biologically active portion of a pesticidal protein. Thus, a fragment of a nucleic acid of the embodiments may encode a biologically active portion of a pesticidal protein, or it may be a fragment that can be used as a hybridization probe or PCR primer using methods disclosed herein. A biologically active portion of a pesticidal protein can be prepared by isolating a portion of one of the nucleotide sequences of the embodiments, expressing the encoded portion of the pesticidal protein (e.g., by recombinant expression in vitro), and assessing the activity of the encoded portion of the pesticidal protein.

Nucleic acids that are fragments of a nucleotide sequence of the embodiments comprise at least 16, 20, 50, 75, 100, 150, 200, 250, 300, 350, 400, 450, 500, 600, 700, 800, 850, 900 or 950 nucleotides, or up to the number of nucleotides present in a nucleotide sequence disclosed herein (for example, 1953 nucleotides for SEQ ID NO: 4). Particular embodiments envision fragments derived from (e.g., produced from) a first nucleic acid of the embodiments, wherein the fragment encodes a truncated toxin having pesticidal activity. Truncated polypeptides encoded by the polynucleotide fragments of the embodiments are having pesticidal activity that is either equivalent to, or improved, relative to the activity of the corresponding full-length polypeptide encoded by the first nucleic acid from which the fragment is derived. It is envisioned that such nucleic acid fragments of the embodiments may be truncated at the 3' end of the native or corresponding full-length coding sequence. Nucleic acid fragments may also be truncated at both the 5' and 3' end of the native or corresponding full-length coding sequence.

The term "variants" is used herein to refer to substantially similar sequences. For nucleotide sequences, conservative variants include those sequences that, because of the degeneracy of the genetic code, encode the amino acid sequence of one of the pesticidal polypeptides of the embodiments. Those having ordinary skill in the art will readily appreciate that due to the degeneracy of the genetic code, a multitude of nucleotide sequences encoding of the present disclosure exist.

In some embodiments the nucleic acid molecule encoding the polypeptide is a non-genomic nucleic acid sequence. As used herein a "non-genomic nucleic acid sequence" or "non-genomic nucleic acid molecule" or "non-genomic polynucleotide" refers to a nucleic acid molecule that has one or more change in the nucleic acid sequence compared to a native or genomic nucleic acid sequence. In some embodiments the change to a native or genomic nucleic acid molecule includes but is not limited to: changes in the nucleic acid sequence due to the degeneracy of the genetic code; codon optimization of the nucleic acid sequence for expression in plants; changes in the nucleic acid sequence to introduce at least one amino acid substitution, insertion, deletion and/or addition compared to the native or genomic sequence; removal of one or more intron associated with the genomic nucleic acid sequence; insertion of one or more heterologous introns; deletion of one or more upstream or downstream regulatory regions associated with the genomic nucleic acid sequence; insertion of one or more heterologous upstream or downstream regulatory regions; deletion of the 5' and/or 3' untranslated region associated with the genomic nucleic acid sequence; insertion of a heterologous 5' and/or 3' untranslated region; and modification of a polyadenylation site. In some embodiments the non-genomic nucleic acid molecule is a cDNA. In some embodiments the non-genomic nucleic acid molecule is a synthetic nucleic acid sequence.

Where appropriate, a nucleic acid may be optimized for increased expression in the host organism. Thus, where the host organism is a plant, the synthetic nucleic acids can be synthesized using plant-preferred codons for improved expression. See, for example, Campbell and Gowri, (1990) *Plant Physiol.* 92:1-11 for a discussion of host-preferred codon usage. For example, although nucleic acid sequences of the embodiments may be expressed in both monocotyledonous and dicotyledonous plant species, sequences can be modified to account for the specific codon preferences and GC content preferences of monocotyledons or dicotyledons as these preferences have been shown to differ (Murray et al. (1989) *Nucleic Acids Res.* 17:477-498). Thus, the maize-preferred codon for a particular amino acid may be derived from known gene sequences from maize. Maize codon usage for 28 genes from maize plants is listed in Table 4 of Murray, et al., supra. Methods are available in the art for synthesizing plant-preferred genes. A *Zea* maize codon usage table can be also found at kazusa.or.jp/codon/cgi-bin/showcodon.cgi?species=4577, which can be accessed using the www prefix.

A *Glycine max* codon usage table is shown in Table 3 and can also be found at kazusa.or.jp/codon/cgi-bin/showcodon.cgi?species=3847&aa=1&style=N, which can be accessed using the www prefix.

The skilled artisan will further appreciate that changes can be introduced by mutation of the nucleic acid sequences thereby leading to changes in the amino acid sequence of the encoded polypeptides, without altering the biological activity of the proteins. Thus, variant nucleic acid molecules can be created by introducing one or more nucleotide substitutions, additions and/or deletions into the corresponding nucleic acid sequence disclosed herein, such that one or more amino acid substitutions, additions or deletions are introduced into the encoded protein. Mutations can be introduced by standard techniques, such as site-directed mutagenesis and PCR-mediated mutagenesis. Such variant nucleic acid sequences are also encompassed by the present disclosure.

Naturally occurring allelic variants such as these can be identified with the use of well-known molecular biology techniques, such as, for example, polymerase chain reaction (PCR) and hybridization techniques as outlined herein.

In some embodiments the polynucleotide encoding the polypeptide of SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43 or SEQ ID NO: 45 is a non-genomic nucleic acid sequence.

Variant nucleotide sequences also include synthetically derived nucleotide sequences, such as those generated, for example, by using site-directed mutagenesis but which still encode a pesticidal protein of the embodiments, such as a mutant toxin. Generally, variants of a particular nucleotide sequence of the embodiments will have at least about 70%, 75%, 80%, 85%, 86%, 87%, 88%, 89%, 90%, 91%, 92%, 93%, 94%, 95%, 96%, 97%, 98%, 99%, or more sequence identity to that particular nucleotide sequence as determined by sequence alignment programs described elsewhere herein using default parameters. A variant of a nucleotide sequence of the embodiments may differ from that sequence by as few as 1-15 nucleotides, as few as 1-10, such as 6-10, as few as 5, as few as 4, 3, 2, or even 1 nucleotide.

Variants of a particular nucleotide sequence of the embodiments (i.e., an exemplary nucleotide sequence) can also be evaluated by comparison of the percent sequence identity between the polypeptide encoded by a variant nucleotide sequence and the polypeptide encoded by the reference nucleotide sequence. Thus, for example, isolated nucleic acids that encode a polypeptide with a given percent sequence identity to the polypeptides of SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43 or SEQ ID NO: 45 are disclosed. Percent sequence identity between any two polypeptides can be calculated using sequence alignment programs described elsewhere herein using default parameters. Where any given pair of polynucleotides of the embodiments is evaluated by comparison of the percent sequence identity shared by the two polypeptides they encode, the percent sequence identity between the two encoded polypeptides is at least about 40%, 45%, 50%, 55%, 60%, 65%, 70%, generally at least about 75%, 80%, 85%, at least about 90%, 91%, 92%, 93%, 94%, 95%, 96%, 97%, or at least about 98%, 99% or more sequence identity.

As used herein, the term "variant protein" encompasses polypeptides that are derived from a native protein by: deletion (so-called truncation) or addition of one or more amino acids to the N-terminal and/or C-terminal end of the native protein; deletion or addition of one or more amino acids at one or more sites in the native protein; or substitution of one or more amino acids at one or more sites in the native protein. Accordingly, the term "variant protein" encompasses biologically active fragments of a native protein that comprise a sufficient number of contiguous amino acid residues to retain the biological activity of the native protein, i.e., to have pesticidal activity. Such pesticidal activity may be different or improved relative to the native protein or it may be unchanged, so long as pesticidal activity is retained.

Variant proteins encompassed by the embodiments are biologically active, that is they continue to possess the desired biological activity of the native protein, that is, pesticidal activity as described herein. Such variants may result from, for example, genetic polymorphism or from human manipulation. Biologically active variants of a native pesticidal protein of the embodiments will have at least about 60%, 65%, 70%, 75%, 80%, 85%, 86%, 87%, 88%, 89%, 90%, 91%, 92%, 93%, 94%, 95%, 96%, 97%, 98%, 99%, or more sequence identity to the amino acid sequence for the native protein as determined by sequence alignment programs described elsewhere herein using default parameters. A biologically active variant of a protein of the embodiments may differ from that protein by as few as 1-15 amino acid residues, as few as 1-10, such as 6-10, as few as 5, as few as 4, 3, 2, or even 1 amino acid residue.

In some embodiment the insecticidal polypeptide has at least 60%, 65%, 70%, 75%, 80%, 85%, 86%, 87%, 88%, 89%, 90%, 91%, 92%, 93%, 94%, 95%, 96%, 97%, 98%, 99%, or more sequence identity to the amino acid sequence of SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43 or SEQ ID NO: 45.

In some embodiment the insecticidal polypeptide has at least 60%, 65%, 70%, 75%, 80%, 85%, 86%, 87%, 88%, 89%, 90%, 91%, 92%, 93%, 94%, 95%, 96%, 97%, 98%, 99%, or more sequence identity to the amino acid sequence of SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77 or SEQ ID NO: 78.

In some embodiment the insecticidal polypeptide has at least 60%, 65%, 70%, 75%, 80%, 85%, 86%, 87%, 88%, 89%, 90%, 91%, 92%, 93%, 94%, 95%, 96%, 97%, 98%, 99%, or more sequence identity to the amino acid sequence of SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143 or SEQ ID NO: 144.

In some embodiments the polypeptide has a modified physical property. As used herein, the term "physical property" refers to any parameter suitable for describing the physical-chemical characteristics of a protein. As used herein, "physical property of interest" and "property of interest" are used interchangeably to refer to physical properties of proteins that are being investigated and/or modified. Examples of physical properties include, but are not limited to net surface charge and charge distribution on the protein surface, net hydrophobicity and hydrophobic residue distribution on the protein surface, surface charge density, surface hydrophobicity density, total count of surface ionizable groups, surface tension, protein size and its distribution in solution, melting temperature, heat capacity, and second virial coefficient. Examples of physical properties also include, but are not limited to solubility, folding, stability, and digestibility. In some embodiments the polypeptide has increased digestibility of proteolytic fragments in an insect gut. In some embodiments the polypeptide has increased stability in an insect gut. Models for digestion by simulated gastric fluids are known to one skilled in the art (Fuchs, R. L. and J. D. Astwood. *Food Technology* 50: 83-88, 1996; Astwood, J. D., et al *Nature Biotechnology* 14: 1269-1273, 1996; Fu T J et al J. *Agric Food Chem.* 50: 7154-7160, 2002).

In some embodiments chimeric Cry1B polypeptides are provided. In some embodiments chimeric Cry1B polypeptides are provided comprising Domain I of a first Cry1B polypeptide and Domain II and Domain III of a second Cry1B polypeptide. In some embodiments chimeric Cry1B polypeptides are provided comprising Domain I of Cry1Bd (SEQ ID NO: 1) and Domain II and Domain III of MP258 (SEQ ID NO: 47). In some embodiments chimeric Cry1B polypeptides are provided comprising Domain I of MP258 (SEQ ID NO: 47) and Domain II and Domain III of Cry1Bd (SEQ ID NO: 1). In some embodiments chimeric Cry1B polypeptides are provided comprising a Domain II of a first Cry1B polypeptide and a Domain I and Domain III of a second Cry1B polypeptide. In some embodiments chimeric Cry1B polypeptides are provided comprising Domain II of MP258 (SEQ ID NO: 47) Domain I and Domain III of Cry1Bd (SEQ ID NO: 1). In some embodiments chimeric Cry1B polypeptides are provided comprising Domain II of Cry1Bd (SEQ ID NO: 1) Domain I and Domain III of MP258 (SEQ ID NO: 47). In some embodiments chimeric Cry1B polypeptides are provided comprising Domain I, Domain II and Domain III of a first Cry1B polypeptide where one two or three of the alpha helices in Domain I are replaced with the corresponding alpha helices of a second Cry1B polypeptide. In some embodiments chimeric Cry1B polypeptides are provided comprising Domain I, Domain II and Domain III of a Cry1B polypeptide where one two or three of the alpha helices in Domain I are replaced with the corresponding alpha helices of MP258 (SEQ ID NO: 47). In some embodiments chimeric Cry1B polypeptides are provided comprising Domain I, Domain II and Domain III of Cry1Bd (SEQ ID NO: 1) where one two or three of the alpha helices in Domain I are replaced with the corresponding alpha helices of MP258 (SEQ ID NO: 47). In some embodiments chimeric Cry1B polypeptides are provided comprising Domain I, Domain II and Domain III of MP258 (SEQ ID NO: 47) where one two or three of the alpha helices in Domain I are replaced with the corresponding alpha helices of Cry1Bd (SEQ ID NO: 1). In some embodiments the chimeric Cry1B polypeptide comprises the amino acid sequence of SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159 or SEQ ID NO: 160.

The embodiments further encompass a microorganism that is transformed with at least one nucleic acid of the embodiments, with an expression cassette comprising the nucleic acid, or with a vector comprising the expression cassette. In some embodiments, the microorganism is one that multiplies on plants. An embodiment of the disclosure relates to an encapsulated pesticidal protein which comprises a transformed microorganism capable of expressing at least one pesticidal protein of the embodiments.

The embodiments provide pesticidal compositions comprising a transformed microorganism of the embodiments. In such embodiments, the transformed microorganism is generally present in the pesticidal composition in a pesticidally effective amount, together with a suitable carrier. The embodiments also encompass pesticidal compositions comprising an isolated protein of the embodiments, alone or in combination with a transformed organism of the embodiments and/or an encapsulated pesticidal protein of the embodiments, in an insecticidally effective amount, together with a suitable carrier.

The embodiments further provide a method of increasing insect target range by using a pesticidal protein of the embodiments in combination with at least one other or "second" pesticidal protein. Any pesticidal protein known in the art can be employed in the methods of the embodiments. Such pesticidal proteins include, but are not limited to, Bt toxins, protease inhibitors, α-amylases, and peroxidases.

The embodiments also encompass transformed or transgenic plants comprising at least one nucleotide sequence of the embodiments. In some embodiments, the plant is stably transformed with a nucleotide construct comprising at least one nucleotide sequence of the embodiments operably linked to a promoter that drives expression in a plant cell. As used herein, the terms "transformed plant" and "transgenic plant" refer to a plant that comprises within its genome a heterologous polynucleotide. Generally, the heterologous polynucleotide is stably integrated within the genome of a transgenic or transformed plant such that the polynucleotide is passed on to successive generations. The heterologous polynucleotide may be integrated into the genome alone or as part of a recombinant expression cassette.

It is to be understood that as used herein the term "transgenic" includes any cell, cell line, callus, tissue, plant part, or plant the genotype of which has been altered by the presence of heterologous nucleic acid including those transgenics initially so altered as well as those created by sexual crosses or asexual propagation from the initial transgenic. The term "transgenic" as used herein does not encompass the alteration of the genome (chromosomal or extra-chromosomal) by conventional plant breeding methods or by naturally occurring events such as random cross-fertilization, non-recombinant viral infection, non-recombinant bacterial transformation, non-recombinant transposition, or spontaneous mutation.

As used herein, the term "plant" includes whole plants, plant organs (e.g., leaves, stems, roots, etc.), seeds, plant cells, and progeny of same. Parts of transgenic plants are within the scope of the embodiments and comprise, for example, plant cells, plant protoplasts, plant cell tissue cultures from which plants can be regenerated, plant calli, plant clumps, and plant cells that are intact in plants or parts of plants such as embryos, pollen, ovules, seeds, leaves, flowers, branches, fruit, kernels, ears, cobs, husks, stalks, roots, root tips, anthers, and the like, originating in transgenic plants or their progeny previously transformed with a DNA molecule of the embodiments and therefore consisting at least in part of transgenic cells. The class of plants that can be used in the methods of the embodiments is generally as broad as the class of higher plants amenable to transformation techniques, including both monocotyledonous and dicotyledonous plants.

While the embodiments do not depend on a particular biological mechanism for increasing the resistance of a plant to a plant pest, expression of the nucleotide sequences of the embodiments in a plant can result in the production of the pesticidal proteins of the embodiments and in an increase in the resistance of the plant to a plant pest. The plants of the embodiments find use in agriculture in methods for impacting insect pests. Certain embodiments provide transformed crop plants, such as, for example, maize plants, which find use in methods for impacting insect pests of the plant, such as, for example, Lepidopteran pests.

A "subject plant or plant cell" is one in which genetic alteration, such as transformation, has been affected as to a gene of interest, or is a plant or plant cell which is descended from a plant or cell so altered and which comprises the alteration. A "control" or "control plant" or "control plant cell" provides a reference point for measuring changes in phenotype of the subject plant or plant cell.

A control plant or plant cell may comprise, for example: (a) a wild-type plant or cell, i.e., of the same genotype as the starting material for the genetic alteration which resulted in the subject plant or cell; (b) a plant or plant cell of the same genotype as the starting material but which has been transformed with a null construct (i.e., with a construct which has no known effect on the trait of interest, such as a construct comprising a marker gene); (c) a plant or plant cell which is a non-transformed segregant among progeny of a subject plant or plant cell; (d) a plant or plant cell genetically identical to the subject plant or plant cell but which is not exposed to conditions or stimuli that would induce expression of the gene of interest; or (e) the subject plant or plant cell itself, under conditions in which the gene of interest is not expressed.

One of skill in the art will readily acknowledge that advances in the field of molecular biology such as site-specific and random mutagenesis, polymerase chain reaction methodologies, and protein engineering techniques provide an extensive collection of tools and protocols suitable for use to alter or engineer both the amino acid sequence and underlying genetic sequences of proteins of agricultural interest.

Thus, the proteins of the embodiments may be altered in various ways including amino acid substitutions, deletions, truncations, and insertions. Methods for such manipulations are generally known in the art. For example, amino acid sequence variants of the pesticidal proteins can be prepared by introducing mutations into a synthetic nucleic acid (e.g., DNA molecule). Methods for mutagenesis and nucleic acid alterations are well known in the art. For example, designed changes can be introduced using an oligonucleotide-mediated site-directed mutagenesis technique. See, for example, Kunkel (1985) *Proc. Natl. Acad. Sci. USA* 82:488-492; Kunkel et al. (1987) *Methods in Enzymol.* 154:367-382; U.S. Pat. No. 4,873,192; Walker and Gaastra, eds. (1983) *Techniques in Molecular Biology* (MacMillan Publishing Company, New York), and the references cited therein.

The mutagenized nucleotide sequences of the embodiments may be modified so as to change about 1, 2, 3, 4, 5, 6, 8, 10, 12 or more of the amino acids present in the primary sequence of the encoded polypeptide. Alternatively, even more changes from the native sequence may be introduced such that the encoded protein may have at least about 1% or 2%, or about 3%, 4%, 5%, 6%, 7%, 8%, 9%, 10%, 11%, 12%, or even about 13%, 14%, 15%, 16%, 17%, 18%, 19%, or 20%, 21%, 22%, 23%, 24%, or 25%, 30%, 35%, or 40% or more of the codons altered, or otherwise modified compared to the corresponding wild-type protein. In the same manner, the encoded protein may have at least about 1% or 2%, or about 3%, 4%, 5%, 6%, 7%, 8%, 9%, 10%, 11%, 12%, or even about 13%, 14%, 15%, 16%, 17%, 18%, 19%, or 20%, 21%, 22%, 23%, 24%, or 25%, 30%, 35%, or 40% or more additional codons compared to the corresponding wild-type protein. It should be understood that the mutagenized nucleotide sequences of the embodiments are intended to encompass biologically functional, equivalent peptides which have pesticidal activity, such as an improved pesticidal activity as determined by antifeedant properties against European corn borer larvae. Such sequences may arise as a consequence of codon redundancy and functional equivalency that are known to occur naturally within nucleic acid sequences and the proteins thus encoded.

One of skill in the art would recognize that amino acid additions and/or substitutions are generally based on the relative similarity of the amino acid side-chain substituents, for example, their hydrophobicity, charge, size, and the like. Exemplary amino acid substitution groups that take several of the foregoing characteristics into consideration are well known to those of skill in the art and include: arginine and lysine; glutamate and aspartate; serine and threonine; glutamine and asparagine; and valine, leucine, and isoleucine.

Guidance as to appropriate amino acid substitutions that do not affect biological activity of the protein of interest may be found in the model of Dayhoff et al. (1978) *Atlas of Protein Sequence and Structure* (Natl. Biomed. Res. Found., Washington, D.C.), herein incorporated by reference. Conservative substitutions, such as exchanging one amino acid with another having similar properties, may be made.

Thus, the genes and nucleotide sequences of the embodiments include both the naturally occurring sequences and mutant forms. Likewise, the proteins of the embodiments encompass both naturally occurring proteins and variations (e.g., truncated polypeptides) and modified (e.g., mutant) forms thereof. Such variants will continue to possess the desired pesticidal activity. Obviously, the mutations that will be made in the nucleotide sequence encoding the variant must not place the sequence out of reading frame and generally will not create complementary regions that could produce secondary mRNA structure. See, EP Patent Application Publication No. 75,444.

The deletions, insertions, and substitutions of the protein sequences encompassed herein are not expected to produce radical changes in the characteristics of the protein. However, when it is difficult to predict the exact effect of the substitution, deletion, or insertion in advance of doing so, one skilled in the art will appreciate that the effect will be evaluated by routine screening assays, such as insect-feeding assays. See, for example, Marrone et al. (1985) *J. Econ. Entomol.* 78: 290-293 and Czapla and Lang (1990) *J. Econ. Entomol.* 83: 2480-2485, herein incorporated by reference.

Variant nucleotide sequences and proteins also encompass sequences and proteins derived from a mutagenic and recombinogenic procedure such as DNA shuffling. With such a procedure, one or more different coding sequences can be manipulated to create a new pesticidal protein possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, full-length coding sequences, sequence motifs encoding a domain of interest, or any fragment of a nucleotide sequence of the embodiments may be shuffled between the nucleotide sequences of the embodiments and corresponding portions of other known Cry nucleotide sequences to obtain a new gene coding for a protein with an improved property of interest.

Properties of interest include, but are not limited to, pesticidal activity per unit of pesticidal protein, protein stability, and toxicity to non-target species particularly humans, livestock, and plants and microbes that express the pesticidal polypeptides of the embodiments. The embodiments are not bound by a particular shuffling strategy, only that at least one nucleotide sequence of the embodiments, or part thereof, is involved in such a shuffling strategy. Shuffling may involve only nucleotide sequences disclosed herein or may additionally involve shuffling of other nucleotide sequences known in the art. Strategies for DNA shuffling are known in the art. See, for example, Stemmer (1994) *Proc. Natl. Acad. Sci. USA* 91:10747-10751; Stemmer (1994) *Nature* 370:389-391; Crameri et al. (1997) *Nature Biotech.* 15:436-438; Moore et al. (1997) *J. Mol. Biol.* 272:336-347; Zhang et al. (1997) *Proc. Natl. Acad. Sci. USA* 94:4504-4509; Crameri et al. (1998) *Nature* 391:288-291; and U.S. Pat. Nos. 5,605,793 and 5,837,458.

The nucleotide sequences of the embodiments can also be used to isolate corresponding sequences from other organisms, particularly other bacteria, and more particularly other *Bacillus* strains. In this manner, methods such as PCR, hybridization, and the like can be used to identify such sequences based on their sequence homology to the sequences set forth herein. Sequences that are selected based on their sequence identity to the entire sequences set forth herein or to fragments thereof are encompassed by the embodiments. Such sequences include sequences that are orthologs of the disclosed sequences. The term "orthologs" refers to genes derived from a common ancestral gene and which are found in different species as a result of speciation. Genes found in different species are considered orthologs when their nucleotide sequences and/or their encoded protein sequences share substantial identity as defined elsewhere herein. Functions of orthologs are often highly conserved among species.

In a PCR approach, oligonucleotide primers can be designed for use in PCR reactions to amplify corresponding DNA sequences from cDNA or genomic DNA extracted from any organism of interest. Methods for designing PCR primers and PCR cloning are generally known in the art and are disclosed in Sambrook et al. (1989) *Molecular Cloning: A Laboratory Manual* (2d ed., Cold Spring Harbor Laboratory Press, Plainview, N.Y.), hereinafter "Sambrook". See also Innis et al., eds. (1990) *PCR Protocols: A Guide to Methods and Applications* (Academic Press, New York); Innis and Gelfand, eds. (1995) *PCR Strategies* (Academic Press, New York); and Innis and Gelfand, eds. (1999) *PCR Methods Manual* (Academic Press, New York). Known methods of PCR include, but are not limited to, methods using paired primers, nested primers, single specific primers, degenerate primers, gene-specific primers, vector-specific primers, partially-mismatched primers, and the like.

In hybridization techniques, all or part of a known nucleotide sequence is used as a probe that selectively hybridizes to other corresponding nucleotide sequences present in a population of cloned genomic DNA fragments or cDNA fragments (i.e., genomic or cDNA libraries) from a chosen organism. The hybridization probes may be genomic DNA fragments, cDNA fragments, RNA fragments, or other oligonucleotides, and may be labeled with a detectable group such as $^{32}P$ or any other detectable marker. Thus, for example, probes for hybridization can be made by labeling synthetic oligonucleotides based on the sequences of the embodiments. Methods for preparation of probes for hybridization and for construction of cDNA and genomic libraries are generally known in the art and are disclosed in Sambrook.

For example, an entire sequence disclosed herein, or one or more portions thereof, may be used as a probe capable of specifically hybridizing to corresponding sequences and messenger RNAs. To achieve specific hybridization under a variety of conditions, such probes include sequences that are unique to the sequences of the embodiments and are generally at least about 10 or 20 nucleotides in length. Such probes may be used to amplify corresponding Cry sequences from a chosen organism by PCR. This technique may be used to isolate additional coding sequences from a desired organism or as a diagnostic assay to determine the presence of coding sequences in an organism. Hybridization techniques include hybridization screening of plated DNA libraries (either plaques or colonies; see, for example, Sambrook).

Hybridization of such sequences may be carried out under stringent conditions. The term "stringent conditions" or "stringent hybridization conditions" as used herein refers to conditions under which a probe will hybridize to its target sequence to a detectably greater degree than to other sequences (e.g., at least 2-fold, 5-fold, or 10-fold over background). Stringent conditions are sequence-dependent and will be different in different circumstances. By controlling the stringency of the hybridization and/or washing conditions, target sequences that are 100% complementary to the probe can be identified (homologous probing). Alternatively, stringency conditions can be adjusted to allow some mismatching in sequences so that lower degrees of similarity are detected (heterologous probing). Generally, a probe is less than about 1000 or 500 nucleotides in length.

Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulfate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SDS at 37 C, and a wash in 0.5× to 1×SSC at 55 to 60° C. Exemplary high stringency conditions include hybridization in 50% formamide, 1 M NaCl, 1% SDS at 37° C., and a final wash in 0.1×SSC at 60 to 65° C. for at least about 20 minutes. Optionally, wash buffers may comprise about 0.1% to about 1% SDS. The duration of hybridization is generally less than about 24 hours, usually about 4 to about 12 hours.

The following terms are used to describe the sequence relationships between two or more nucleic acids or polynucleotides: (a) "reference sequence", (b) "comparison window", (c) "sequence identity", (d) "percentage of sequence identity", and (e) "substantial identity".

(a) As used herein, "reference sequence" is a defined sequence used as a basis for sequence comparison. A reference sequence may be a subset or the entirety of a specified sequence; for example, as a segment of a full-length cDNA or gene sequence, or the complete cDNA or gene sequence.

(b) As used herein, "comparison window" makes reference to a contiguous and specified segment of a polynucleotide sequence, wherein the polynucleotide sequence in the comparison window may comprise additions or deletions (i.e., gaps) compared to the reference sequence (which does not comprise additions or deletions) for optimal alignment of the two sequences. Generally, the comparison window is at least 20 contiguous nucleotides in length, and optionally can be 30, 40, 50, 100, or longer. Those of skill in the art understand that to avoid a high similarity to a reference sequence due to inclusion of gaps in the polynucleotide sequence a gap penalty is typically introduced and is subtracted from the number of matches.

Methods of alignment of sequences for comparison are well known in the art. Thus, the determination of percent sequence identity between any two sequences can be accomplished using a mathematical algorithm. Non-limiting examples of such mathematical algorithms are the algorithm of Myers and Miller (1988) *CABIOS* 4:11-17; the local alignment algorithm of Smith et al. (1981) *Adv. Appl. Math.* 2:482; the global alignment algorithm of Needleman and Wunsch (1970) *J. Mol. Biol.* 48:443-453; the search-for-local alignment method of Pearson and Lipman (1988) *Proc. Natl. Acad. Sci.* 85:2444-2448; the algorithm of Karlin and Altschul (1990) *Proc. Natl. Acad. Sci. USA* 872264, as modified in Karlin and Altschul (1993) *Proc. Natl. Acad. Sci. USA* 90:5873-5877.

Computer implementations of these mathematical algorithms can be utilized for comparison of sequences to determine sequence identity. Such implementations include, but are not limited to: CLUSTAL in the PC/Gene program (available from Intelligenetics, Mountain View, Calif.); the ALIGN program (Version 2.0) and GAP, BESTFIT, BLAST, FASTA, and TFASTA in the GCG Wisconsin Genetics Software Package, Version 10 (available from Accelrys Inc., 9685 Scranton Road, San Diego, Calif., USA). Alignments using these programs can be performed using the default parameters. The CLUSTAL program is well described by Higgins et al. (1988) *Gene* 73:237-244 (1988); Higgins et al. (1989) *CABIOS* 5:151-153; Corpet et al. (1988) *Nucleic Acids Res.* 16:10881-90; Huang et al. (1992) *CABIOS* 8:155-65; and Pearson et al. (1994) *Meth. Mol. Biol.* 24:307-331. The ALIGN program is based on the algorithm of Myers and Miller (1988) supra. A PAM120 weight residue table, a gap length penalty of 12, and a gap penalty of 4 can be used with the ALIGN program when comparing amino acid sequences. The BLAST programs of Altschul et al (1990) *J. Mol. Biol.* 215:403 are based on the algorithm of Karlin and Altschul (1990) supra. BLAST nucleotide searches can be performed with the BLASTN program, score=100, wordlength=12, to obtain nucleotide sequences homologous to a nucleotide sequence encoding a protein of the embodiments. BLAST protein searches can be performed with the BLASTX program, score=50, wordlength=3, to obtain amino acid sequences homologous to a protein or polypeptide of the embodiments. To obtain gapped alignments for comparison purposes, Gapped BLAST (in BLAST 2.0) can be utilized as described in Altschul et al. (1997) *Nucleic Acids Res.* 25:3389. Alternatively, PSI-BLAST (in BLAST 2.0) can be used to perform an iterated search that detects distant relationships between molecules. See Altschul et al. (1997) supra. When utilizing BLAST, Gapped BLAST, PSI-BLAST, the default parameters of the respective programs (e.g., BLASTN for nucleotide sequences, BLASTX for proteins) can be used. See the National Center for Biotechnology Information website on the world wide web at ncbi.hlm.nih.gov. Alignment may also be performed manually by inspection.

(c) As used herein, "sequence identity" or "identity" in the context of two nucleic acid or polypeptide sequences makes reference to the residues in the two sequences that are the same when aligned for maximum correspondence over a specified comparison window. When percentage of sequence identity is used in reference to proteins it is recognized that residue positions which are not identical often differ by conservative amino acid substitutions, where amino acid residues are substituted for other amino acid residues with similar chemical properties (e.g., charge or hydrophobicity) and therefore do not change the functional properties of the molecule. When sequences differ in conservative substitutions, the percent sequence identity may be adjusted upwards to correct for the conservative nature of the substitution. Sequences that differ by such conservative substitutions are said to have "sequence similarity" or "similarity". Means for making this adjustment are well known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., as implemented in the program PC/GENE (Intelligenetics, Mountain View, Calif.).

(d) As used herein, "percentage of sequence identity" means the value determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percentage of sequence identity.

(e)(i) The term "substantial identity" of polynucleotide sequences means that a polynucleotide comprises a sequence that has at least 70%. 80%, 90%, or 95% or more sequence identity when compared to a reference sequence using one of the alignment programs described using standard parameters. One of skill in the art will recognize that these values can be appropriately adjusted to determine corresponding identity of proteins encoded by two nucleotide sequences by taking into account codon degeneracy, amino acid similarity, reading frame positioning, and the like. Substantial identity of amino acid sequences for these purposes generally means sequence identity of at least 60%, 70%, 80%, 90%, or 95% or more sequence identity.

Another indication that nucleotide sequences are substantially identical is if two molecules hybridize to each other under stringent conditions. Generally, stringent conditions are selected to be about 5° C. lower than the $T_m$ for the specific sequence at a defined ionic strength and pH. However, stringent conditions encompass temperatures in the range of about 1° C. to about 20° C. lower than the $T_m$, depending upon the desired degree of stringency as otherwise qualified herein. Nucleic acids that do not hybridize to each other under stringent conditions are still substantially identical if the polypeptides they encode are substantially identical. This may occur, e.g., when a copy of a nucleic acid is created using the maximum codon degeneracy permitted by the genetic code. One indication that two nucleic acid sequences are substantially identical is when the polypeptide encoded by the first nucleic acid is immunologically cross reactive with the polypeptide encoded by the second nucleic acid.

(e)(ii) The term "substantial identity" in the context of a peptide indicates that a peptide comprises a sequence with at least 70%, 80%, 85%, 90%, 95%, or more sequence identity to a reference sequence over a specified comparison window. Optimal alignment for these purposes can be conducted using the global alignment algorithm of Needleman and Wunsch (1970) supra. An indication that two peptide sequences are substantially identical is that one peptide is immunologically reactive with antibodies raised against the second peptide. Thus, a peptide is substantially identical to a second peptide, for example, where the two peptides differ only by a conservative substitution. Peptides that are "substantially similar" share sequences as noted above except that residue positions that are not identical may differ by conservative amino acid changes.

The use of the term "nucleotide constructs" herein is not intended to limit the embodiments to nucleotide constructs comprising DNA. Those of ordinary skill in the art will recognize that nucleotide constructs, particularly polynucleotides and oligonucleotides composed of ribonucleotides and combinations of ribonucleotides and deoxyribonucleotides, may also be employed in the methods disclosed herein. The nucleotide constructs, nucleic acids, and nucleotide sequences of the embodiments additionally encompass all complementary forms of such constructs, molecules, and sequences. Further, the nucleotide constructs, nucleotide molecules, and nucleotide sequences of the embodiments encompass all nucleotide constructs, molecules, and sequences which can be employed in the methods of the embodiments for transforming plants including, but not limited to, those comprised of deoxyribonucleotides, ribonucleotides, and combinations thereof. Such deoxyribonucleotides and ribonucleotides include both naturally occurring molecules and synthetic analogues. The nucleotide constructs, nucleic acids, and nucleotide sequences of the embodiments also encompass all forms of nucleotide constructs including, but not limited to, single-stranded forms, double-stranded forms, hairpins, stem-and-loop structures, and the like.

A further embodiment relates to a transformed organism such as an organism selected from the group consisting of plant and insect cells, bacteria, yeast, baculovirus, protozoa, nematodes, and algae. The transformed organism comprises: a DNA molecule of the embodiments, an expression cassette comprising the said DNA molecule, or a vector comprising the said expression cassette, which may be stably incorporated into the genome of the transformed organism.

The sequences of the embodiments are provided in DNA constructs for expression in the organism of interest. The construct will include 5' and 3' regulatory sequences operably linked to a sequence of the embodiments. The term "operably linked" as used herein refers to a functional linkage between a promoter and a second sequence, wherein the promoter sequence initiates and mediates transcription of the DNA sequence corresponding to the second sequence. Generally, operably linked means that the nucleic acid sequences being linked are contiguous and, where necessary to join two protein coding regions, contiguous and in the same reading frame. The construct may additionally contain at least one additional gene to be cotransformed into the organism. Alternatively, the additional gene(s) can be provided on multiple DNA constructs.

Such a DNA construct is provided with a plurality of restriction sites for insertion of the Cry toxin sequence to be under the transcriptional regulation of the regulatory regions. The DNA construct may additionally contain selectable marker genes.

The DNA construct will include in the 5' to 3' direction of transcription: a transcriptional and translational initiation region (i.e., a promoter), a DNA sequence of the embodiments, and a transcriptional and translational termination region (i.e., termination region) functional in the organism serving as a host. The transcriptional initiation region (i.e., the promoter) may be native, analogous, foreign or heterologous to the host organism and/or to the sequence of the embodiments. Additionally, the promoter may be the natural sequence or alternatively a synthetic sequence. The term "foreign" as used herein indicates that the promoter is not found in the native organism into which the promoter is introduced. Where the promoter is "foreign" or "heterologous" to the sequence of the embodiments, it is intended that the promoter is not the native or naturally occurring promoter for the operably linked sequence of the embodiments. As used herein, a chimeric gene comprises a coding sequence operably linked to a transcription initiation region that is heterologous to the coding sequence. Where the promoter is a native or natural sequence, the expression of the operably linked sequence is altered from the wild-type expression, which results in an alteration in phenotype.

The termination region may be native with the transcriptional initiation region, may be native with the operably linked DNA sequence of interest, may be native with the plant host, or may be derived from another source (i.e., foreign or heterologous to the promoter, the sequence of interest, the plant host, or any combination thereof).

Convenient termination regions are available from the Ti-plasmid of *A. tumefaciens*, such as the octopine synthase and nopaline synthase termination regions. See also Guerineau et al. (1991) *Mol. Gen. Genet.* 262:141-144; Proudfoot (1991) *Cell* 64:671-674; Sanfacon et al. (1991) *Genes Dev.* 5:141-149; Mogen et al. (1990) *Plant Cell* 2:1261-1272; Munroe et al. (1990) *Gene* 91:151-158; Ballas et al. (1989) *Nucleic Acids Res.* 17:7891-7903; and Joshi et al. (1987) *Nucleic Acid Res.* 15:9627-9639.

Where appropriate, a nucleic acid may be optimized for increased expression in the host organism. Thus, where the host organism is a plant, the synthetic nucleic acids can be synthesized using plant-preferred codons for improved expression. See, for example, Campbell and Gowri (1990) *Plant Physiol.* 92:1-11 for a discussion of host-preferred codon usage. For example, although nucleic acid sequences of the embodiments may be expressed in both monocotyledonous and dicotyledonous plant species, sequences can be modified to account for the specific codon preferences and GC content preferences of monocotyledons or dicotyledons as these preferences have been shown to differ (Murray et al. (1989) *Nucleic Acids Res.* 17:477-498). Thus, the maize-preferred codon for a particular amino acid may be derived from known gene sequences from maize. Maize codon usage for 28 genes from maize plants is listed in Table 4 of Murray et al., supra. Methods are available in the art for synthesizing plant-preferred genes.

Additional sequence modifications are known to enhance gene expression in a cellular host. These include elimination of sequences encoding spurious polyadenylation signals, exon-intron splice site signals, transposon-like repeats, and other well-characterized sequences that may be deleterious to gene expression. The GC content of the sequence may be adjusted to levels average for a given cellular host, as calculated by reference to known genes expressed in the host cell. The term "host cell" as used herein refers to a cell which contains a vector and supports the replication and/or expression of the expression vector is intended. Host cells may be prokaryotic cells such as *E. coli*, or eukaryotic cells such as yeast, insect, amphibian, or mammalian cells, or monocotyledonous or dicotyledonous plant cells. An example of a monocotyledonous host cell is a maize host cell. When possible, the sequence is modified to avoid predicted hairpin secondary mRNA structures.

The expression cassettes may additionally contain 5' leader sequences. Such leader sequences can act to enhance translation. Translation leaders are known in the art and include: picornavirus leaders, for example, EMCV leader (Encephalomyocarditis 5' noncoding region) (Elroy-Stein et al. (1989) *Proc. Natl. Acad. Sci. USA* 86: 6126-6130); potyvirus leaders, for example, TEV leader (Tobacco Etch Virus) (Gallie et al. (1995) *Gene* 165(2): 233-238), MDMV leader (Maize Dwarf Mosaic Virus), human immunoglobulin heavy-chain binding protein (BiP) (Macejak et al. (1991) *Nature* 353: 90-94); untranslated leader from the coat protein mRNA of alfalfa mosaic virus (AMV RNA 4) (Jobling et al. (1987) *Nature* 325: 622-625); tobacco mosaic virus leader (TMV) (Gallie et al. (1989) in *Molecular Biology of RNA*, ed. Cech (Liss, New York), pp. 237-256); and maize chlorotic mottle virus leader (MCMV) (Lommel et al. (1991) *Virology* 81: 382-385). See also, Della-Cioppa et al. (1987) *Plant Physiol.* 84: 965-968.

In preparing the expression cassette, the various DNA fragments may be manipulated so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites, or the like. For this purpose, in vitro mutagenesis, primer repair, restriction, annealing, resubstitutions, e.g., transitions and transversions, may be involved.

A number of promoters can be used in the practice of the embodiments. The promoters can be selected based on the desired outcome. The nucleic acids can be combined with constitutive, tissue-preferred, inducible, or other promoters for expression in the host organism. Suitable constitutive promoters for use in a plant host cell include, for example, the core promoter of the Rsyn7 promoter and other constitutive promoters disclosed in WO 99/43838 and U.S. Pat. No. 6,072,050; the core CaMV 35S promoter (Odell et al. (1985) *Nature* 313: 810-812); rice actin (McElroy et al. (1990) *Plant Cell* 2: 163-171); ubiquitin (Christensen et al. (1989) *Plant Mol. Biol.* 12: 619-632 and Christensen et al. (1992) *Plant Mol. Biol.* 18: 675-689); pEMU (Last et al. (1991) *Theor. Appl. Genet.* 81: 581-588); MAS (Velten et al. (1984) *EMBO J.* 3:2723-2730); ALS promoter (U.S. Pat. No. 5,659,026), and the like. Other constitutive promoters include, for example, those discussed in U.S. Pat. Nos. 5,608,149; 5,608,144; 5,604,121; 5,569,597; 5,466,785; 5,399,680; 5,268,463; 5,608,142; and 6,177,611.

Depending on the desired outcome, it may be beneficial to express the gene from an inducible promoter. Of particular interest for regulating the expression of the nucleotide sequences of the embodiments in plants are wound-inducible promoters. Such wound-inducible promoters, may respond to damage caused by insect feeding, and include potato proteinase inhibitor (pin II) gene (Ryan (1990) *Ann. Rev. Phytopath.* 28: 425-449; Duan et al. (1996) *Nature Biotechnology* 14: 494-498); wun1 and wun2, U.S. Pat. No. 5,428,148; win1 and win2 (Stanford et al. (1989) *Mol. Gen. Genet.* 215: 200-208); systemin (McGurl et al. (1992) *Science* 225: 1570-1573); WIP1 (Rohmeier et al. (1993) *Plant Mol. Biol.* 22: 783-792; Eckelkamp et al. (1993) *FEBS Letters* 323: 73-76); MPI gene (Corderok et al. (1994) *Plant J.* 6(2): 141-150); and the like, herein incorporated by reference.

Additionally, pathogen-inducible promoters may be employed in the methods and nucleotide constructs of the embodiments. Such pathogen-inducible promoters include those from pathogenesis-related proteins (PR proteins), which are induced following infection by a pathogen; e.g., PR proteins, SAR proteins, beta-1,3-glucanase, chitinase, etc. See, for example, Redolfi et al. (1983) *Neth. J. Plant Pathol.* 89: 245-254; Uknes et al. (1992) *Plant Cell* 4: 645-656; and Van Loon (1985) *Plant Mol. Virol.* 4: 111-116. See also WO 99/43819, herein incorporated by reference.

Of interest are promoters that are expressed locally at or near the site of pathogen infection. See, for example, Marineau et al. (1987) *Plant Mol. Biol.* 9:335-342; Matton et al. (1989) *Molecular Plant-Microbe Interactions* 2:325-331; Somsisch et al. (1986) *Proc. Natl. Acad. Sci. USA* 83:2427-2430; Somsisch et al. (1988) *Mol. Gen. Genet.* 2:93-98; and Yang (1996) *Proc. Natil. Acad. Sci. USA* 93:14972-14977. See also, Chen et al. (1996) *Plant J.* 10:955-966; Zhang et al. (1994) *Proc. Natil. Acad. Sci. USA* 91:2507-2511; Warner et al. (1993) *Plant J.* 3:191-201; Siebertz et al. (1989) *Plant Cell* 1:961-968; U.S. Pat. No. 5,750,386 (nematode-inducible); and the references cited therein. Of particular interest is the inducible promoter for the maize PRms gene, whose expression is induced by the pathogen *Fusarium moniliforme* (see, for example, Cordero et al. (1992) *Physiol. Mol. Plant Path.* 41:189-200).

Chemical-regulated promoters can be used to modulate the expression of a gene in a plant through the application of an exogenous chemical regulator. Depending upon the objective, the promoter may be a chemical-inducible promoter, where application of the chemical induces gene expression, or a chemical-repressible promoter, where application of the chemical represses gene expression. Chemical-inducible promoters are known in the art and include, but are not limited to, the maize In2-2 promoter, which is activated by benzenesulfonamide herbicide safeners, the maize GST promoter, which is activated by hydrophobic electrophilic compounds that are used as pre-emergent herbicides, and the tobacco PR-1a promoter, which is activated by salicylic acid. Other chemical-regulated promoters of interest include steroid-responsive promoters (see, for example, the glucocorticoid-inducible promoter in Schena et al. (1991) *Proc. Natl. Acad. Sci. USA* 88:10421-10425 and McNellis et al. (1998) *Plant J.* 14(2):247-257) and tetracycline-inducible and tetracycline-repressible promoters (see, for example, Gatz et al. (1991) *Mol. Gen. Genet.* 227:229-237, and U.S. Pat. Nos. 5,814,618 and 5,789,156), herein incorporated by reference.

Tissue-preferred promoters can be utilized to target enhanced pesticidal protein expression within a particular plant tissue. Tissue-preferred promoters include those discussed in Yamamoto et al. (1997) *Plant J.* 12(2)255-265; Kawamata et al. (1997) *Plant Cell Physiol.* 38(7):792-803; Hansen et al. (1997) *Mol. Gen Genet.* 254(3):337-343; Russell et al. (1997) *Transgenic Res.* 6(2):157-168; Rinehart et al. (1996) *Plant Physiol.* 112(3):1331-1341; Van Camp et al. (1996) *Plant Physiol.* 112(2):525-535; Canevascini et al. (1996) *Plant Physiol.* 112(2):513-524; Yamamoto et al. (1994) *Plant Cell Physiol.* 35(5):773-778; Lam (1994) *Results Probl. Cell Differ.* 20:181-196; Orozco et al. (1993) *Plant Mol Biol.* 23(6):1129-1138; Matsuoka et al. (1993) *Proc Natl. Acad. Sci. USA* 90(20):9586-9590; and Guevara-Garcia et al. (1993) *Plant J.* 4(3):495-505. Such promoters can be modified, if necessary, for weak expression.

Leaf-preferred promoters are known in the art. See, for example, Yamamoto et al. (1997) *Plant J.* 12(2):255-265; Kwon et al. (1994) *Plant Physiol.* 105:357-67; Yamamoto et al. (1994) *Plant Cell Physiol.* 35(5):773-778; Gotor et al. (1993) *Plant J.* 3:509-18; Orozco et al. (1993) *Plant Mol. Biol.* 23(6):1129-1138; and Matsuoka et al. (1993) *Proc. Natl. Acad. Sci. USA* 90(20):9586-9590.

Root-preferred or root-specific promoters are known and can be selected from the many available from the literature or isolated de novo from various compatible species. See, for example, Hire et al. (1992) *Plant Mol. Biol.* 20(2):207-218 (soybean root-specific glutamine synthetase gene); Keller and Baumgartner (1991) *Plant Cell* 3(10):1051-1061 (root-specific control element in the GRP 1.8 gene of French bean); Sanger et al. (1990) *Plant Mol. Biol.* 14(3):433-443 (root-specific promoter of the mannopine synthase (MAS) gene of *Agrobacterium tumefaciens*); and Miao et al. (1991) *Plant Cell* 3(1):11-22 (full-length cDNA clone encoding cytosolic glutamine synthetase (GS), which is expressed in roots and root nodules of soybean). See also Bogusz et al. (1990) *Plant Cell* 2(7):633-641, where two root-specific promoters isolated from hemoglobin genes from the nitrogen-fixing nonlegume *Parasponia andersonii* and the related non-nitrogen-fixing nonlegume *Trema tomentosa* are described. The promoters of these genes were linked to a P3-glucuronidase reporter gene and introduced into both the nonlegume *Nicotiana tabacum* and the legume *Lotus corniculatus*, and in both instances root-specific promoter activity was preserved. Leach and Aoyagi (1991) describe their analysis of the promoters of the highly expressed rolC and rolD root-inducing genes of *Agrobacterium rhizogenes* (see Plant Science (Limerick) 79(1):69-76). They concluded that enhancer and tissue-preferred DNA determinants are dissociated in those promoters. Teeri et al. (1989) used gene fusion to lacZ to show that the *Agrobacterium* T-DNA gene encoding octopine synthase is especially active in the epidermis of the root tip and that the TR2' gene is root specific in the intact plant and stimulated by wounding in leaf tissue, an especially desirable combination of characteristics for use with an insecticidal or larvicidal gene (see *EMBO J.* 8(2): 343-350). The TR1' gene fused to nptII (neomycin phosphotransferase II) showed similar characteristics. Additional root-preferred promoters include the VfENOD-GRP3 gene promoter (Kuster et al. (1995) *Plant Mol. Biol.* 29(4):759-772); and rolB promoter (Capana et al. (1994) *Plant Mol. Biol.* 25(4):681-691. See also U.S. Pat. Nos. 5,837,876; 5,750,386; 5,633,363; 5,459,252; 5,401,836; 5,110,732; and 5,023,179.

"Seed-preferred" promoters include both "seed-specific" promoters (those promoters active during seed development such as promoters of seed storage proteins) as well as "seed-germinating" promoters (those promoters active during seed germination). See Thompson et al. (1989) *BioEssays* 10:108, herein incorporated by reference. Such seed-preferred promoters include, but are not limited to, Cim1 (cytokinin-induced message); cZ19B1 (maize 19 kDa zein); and milps (myo-inositol-1-phosphate synthase) (see U.S. Pat. No. 6,225,529, herein incorporated by reference). Gamma-zein and Glob-1 are endosperm-specific promoters. For dicots, seed-specific promoters include, but are not limited to, bean β-phaseolin, napin, P3-conglycinin, soybean lectin, cruciferin, and the like. For monocots, seed-specific promoters include, but are not limited to, maize 15 kDa zein, 22 kDa zein, 27 kDa zein, g-zein, waxy, shrunken 1, shrunken 2, globulin 1, etc. See also WO 00/12733, where seed-preferred promoters from end1 and end2 genes are disclosed; herein incorporated by reference. A promoter that has "preferred" expression in a particular tissue is expressed in that tissue to a greater degree than in at least one other plant tissue. Some tissue-preferred promoters show expression almost exclusively in the particular tissue.

Where low level expression is desired, weak promoters will be used. Generally, the term "weak promoter" as used herein refers to a promoter that drives expression of a coding sequence at a low level. By low level expression at levels of about 1/1000 transcripts to about 1/100,000 transcripts to about 1/500,000 transcripts is intended. Alternatively, it is recognized that the term "weak promoters" also encompasses promoters that drive expression in only a few cells and not in others to give a total low level of expression. Where a promoter drives expression at unacceptably high levels, portions of the promoter sequence can be deleted or modified to decrease expression levels.

Such weak constitutive promoters include, for example the core promoter of the Rsyn7 promoter (WO 99/43838 and U.S. Pat. No. 6,072,050), the core 35S CaMV promoter, and the like. Other constitutive promoters include, for example, those disclosed in U.S. Pat. Nos. 5,608,149; 5,608,144; 5,604,121; 5,569,597; 5,466,785; 5,399,680; 5,268,463; 5,608,142; and 6,177,611; herein incorporated by reference.

Generally, the expression cassette will comprise a selectable marker gene for the selection of transformed cells. Selectable marker genes are utilized for the selection of transformed cells or tissues. Marker genes include genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones, and 2,4-dichlorophenoxyacetate (2,4-D). Additional examples of suitable selectable marker genes include, but are not limited to, genes encoding resistance to chloramphenicol (Herrera Estrella et al. (1983) *EMBO J.* 2:987-992); methotrexate (Herrera Estrella et al. (1983) *Nature* 303:209-213; and Meijer et al. (1991) *Plant Mol. Biol.* 16:807-820); streptomycin (Jones et al. (1987) *Mol. Gen. Genet.* 210:86-91); spectinomycin (Bretagne-Sagnard et al. (1996) *Transgenic Res.* 5:131-137); bleomycin (Hille et al. (1990) *Plant Mol. Biol.* 7:171-176); sulfonamide (Guerineau et al. (1990) *Plant Mol. Biol.* 15:127-136); bromoxynil (Stalker et al. (1988) *Science* 242:419-423); glyphosate (Shaw et al. (1986) *Science* 233:478-481; and U.S. Pat. Nos. 7,709,702; and 7,462,481); phosphinothricin (DeBlock et al. (1987) *EMBO J.* 6:2513-2518). See generally, Yarranton (1992) *Curr. Opin. Biotech.* 3: 506-511; Christopherson et al. (1992) *Proc. Natl. Acad. Sci. USA* 89: 6314-6318; Yao et al. (1992) *Cell* 71: 63-72; Reznikoff (1992) *Mol. Microbiol.* 6: 2419-2422; Barkley et al. (1980) in *The Operon*, pp. 177-220; Hu et al. (1987) *Cell* 48: 555-566; Brown et al. (1987) *Cell* 49: 603-612; Figge et al. (1988) *Cell* 52: 713-722; Deuschle et al. (1989) *Proc. Natl. Acad. Sci. USA* 86: 5400-5404; Fuerst et al. (1989) *Proc. Natl. Acad. Sci. USA* 86: 2549-2553; Deuschle et al. (1990) *Science* 248: 480-483; Gossen (1993) Ph.D. Thesis, University of Heidelberg; Reines et al. (1993) *Proc. Natl. Acad. Sci. USA* 90: 1917-1921; Labow et al. (1990) *Mol. Cell. Biol.* 10: 3343-3356; Zambretti et al. (1992) *Proc. Natl. Acad. Sci. USA* 89: 3952-3956; Baim et al. (1991) *Proc. Natl. Acad. Sci. USA* 88: 5072-5076; Wyborski et al. (1991) *Nucleic Acids Res.* 19: 4647-4653; Hillenand-Wissman (1989) *Topics Mol. Struc. Biol.* 10: 143-162; Degenkolb et al. (1991) *Antimicrob. Agents Chemother.* 35: 1591-1595; Kleinschnidt et al. (1988) *Biochemistry* 27: 1094-1104; Bonin (1993) Ph.D. Thesis, University of Heidelberg; Gossen et al. (1992) *Proc. Natl. Acad. Sci. USA* 89: 5547-5551; Oliva et al. (1992) *Antimicrob. Agents Chemother.* 36: 913-919; Hlavka et al. (1985) *Handbook of Experimental Pharmacology*, Vol. 78 (Springer-Verlag, Berlin); and Gill et al. (1988) *Nature* 334: 721-724. Such disclosures are herein incorporated by reference.

The above list of selectable marker genes is not meant to be limiting. Any selectable marker gene can be used in the embodiments.

The methods of the embodiments involve introducing a polypeptide or polynucleotide into a plant. "Introducing" is intended to mean presenting to the plant the polynucleotide or polypeptide in such a manner that the sequence gains access to the interior of a cell of the plant. The methods of the embodiments do not depend on a particular method for introducing a polynucleotide or polypeptide into a plant, only that the polynucleotide or polypeptides gains access to the interior of at least one cell of the plant. Methods for introducing polynucleotide or polypeptides into plants are known in the art including, but not limited to, stable transformation methods, transient transformation methods, and virus-mediated methods.

"Stable transformation" is intended to mean that the nucleotide construct introduced into a plant integrates into the genome of the plant and is capable of being inherited by the progeny thereof. "Transient transformation" is intended to mean that a polynucleotide is introduced into the plant and does not integrate into the genome of the plant or a polypeptide is introduced into a plant.

Transformation protocols as well as protocols for introducing nucleotide sequences into plants may vary depending on the type of plant or plant cell, i.e., monocot or dicot, targeted for transformation. Suitable methods of introducing nucleotide sequences into plant cells and subsequent insertion into the plant genome include microinjection (Crossway et al. (1986) *Biotechniques* 4: 320-334), electroporation (Riggs et al. (1986) *Proc. Natl. Acad. Sci. USA* 83: 5602-5606), *Agrobacterium*-mediated transformation (U.S. Pat. Nos. 5,563,055 and 5,981,840), direct gene transfer (Paszkowski et al. (1984) *EMBO J.* 3: 2717-2722), and ballistic particle acceleration (see, for example, U.S. Pat. Nos. 4,945,050; 5,879,918; 5,886,244; and 5,932,782; Tomes et al. (1995) in Plant Cell, Tissue, and Organ Culture: Fundamental Methods, ed. Gamborg and Phillips (Springer-Verlag, Berlin); and McCabe et al. (1988) *Biotechnology* 6: 923-926); and Led transformation (WO 00/28058). For potato transformation see Tu et al. (1998) *Plant Molecular Biology* 37: 829-838 and Chong et al. (2000) *Transgenic Research* 9: 71-78. Additional transformation procedures can be found in Weissinger et al. (1988) *Ann. Rev. Genet.* 22: 421-477; Sanford et al. (1987) *Particulate Science and Technology* 5: 27-37 (onion); Christou et al. (1988) *Plant Physiol.* 87: 671-674 (soybean); McCabe et al. (1988) *Bio/Technology* 6: 923-926 (soybean); Finer and McMullen (1991) *In Vitro Cell Dev. Biol.* 27P: 175-182 (soybean); Singh et al. (1998) *Theor. Appl. Genet.* 96: 319-324 (soybean); Datta et al. (1990) *Biotechnology* 8: 736-740 (rice); Klein et al. (1988) *Proc. Natl. Acad. Sci. USA* 85: 4305-4309 (maize); Klein et al. (1988) *Biotechnology* 6:559-563 (maize); U.S. Pat. Nos. 5,240,855; 5,322,783 and 5,324,646; Klein et al. (1988) *Plant Physiol.* 91: 440-444 (maize); Fromm et al. (1990) *Biotechnology* 8: 833-839 (maize); Hooykaas-Van Slogteren et al. (1984) *Nature* (London) 311: 763-764; U.S. Pat. No. 5,736,369 (cereals); Bytebier et al. (1987) *Proc. Natl. Acad. Sci. USA* 84: 5345-5349 (Liliaceae); De Wet et al. (1985) in *The Experimental Manipulation of Ovule Tissues*, ed. Chapman et al. (Longman, New York), pp. 197-209 (pollen); Kaeppler et al. (1990) *Plant Cell Reports* 9: 415-418 and Kaeppler et al. (1992) *Theor. Appl. Genet.* 84: 560-566 (whisker-mediated transformation); D'Halluin et al. (1992) *Plant Cell* 4: 1495-1505 (electroporation); Li et al. (1993) *Plant Cell Reports* 12: 250-255 and Christou and Ford (1995) *Annals of Botany* 75: 407-413 (rice); Osjoda et al. (1996) *Nature Biotechnology* 14: 745-750 (maize via *Agrobacterium tumefaciens*); all of which are herein incorporated by reference.

In specific embodiments, the sequences of the embodiments can be provided to a plant using a variety of transient transformation methods. Such transient transformation methods include, but are not limited to, the introduction of the Cry toxin protein or variants and fragments thereof directly into the plant or the introduction of the Cry toxin transcript into the plant. Such methods include, for example, microinjection or particle bombardment. See, for example, Crossway et al. (1986) *Mol Gen. Genet.* 202: 179-185; Nomura et al. (1986) *Plant Sci.* 44: 53-58; Hepler et al. (1994) *Proc. Natl. Acad. Sci.* 91: 2176-2180 and Hush et al. (1994) *The Journal of Cell Science* 107: 775-784, all of which are herein incorporated by reference. Alternatively, the Cry toxin polynucleotide can be transiently transformed into the plant using techniques known in the art. Such techniques include viral vector system and the precipitation of the polynucleotide in a manner that precludes subsequent release of the DNA. Thus, transcription from the particle-bound DNA can occur, but the frequency with which it is released to become integrated into the genome is greatly reduced. Such methods include the use of particles coated with polyethylimine (PEI; Sigma # P3143).

Methods are known in the art for the targeted insertion of a polynucleotide at a specific location in the plant genome. In one embodiment, the insertion of the polynucleotide at a desired genomic location is achieved using a site-specific recombination system. See, for example, WO99/25821, WO99/25854, WO99/25840, WO99/25855, and WO99/25853, all of which are herein incorporated by reference. Briefly, the polynucleotide of the embodiments can be contained in transfer cassette flanked by two non-identical recombination sites. The transfer cassette is introduced into a plant have stably incorporated into its genome a target site which is flanked by two non-identical recombination sites that correspond to the sites of the transfer cassette. An appropriate recombinase is provided and the transfer cassette is integrated at the target site. The polynucleotide of interest is thereby integrated at a specific chromosomal position in the plant genome.

The cells that have been transformed may be grown into plants in accordance with conventional ways. See, for example, McCormick et al. (1986) *Plant Cell Reports* 5: 81-84. These plants may then be grown, and either pollinated with the same transformed strain or different strains, and the resulting hybrid having constitutive or inducible expression of the desired phenotypic characteristic identified. Two or more generations may be grown to ensure that expression of the desired phenotypic characteristic is stably maintained and inherited and then seeds harvested to ensure that expression of the desired phenotypic characteristic has been achieved.

The nucleotide sequences of the embodiments may be provided to the plant by contacting the plant with a virus or viral nucleic acids. Generally, such methods involve incorporating the nucleotide construct of interest within a viral DNA or RNA molecule. It is recognized that the recombinant proteins of the embodiments may be initially synthesized as part of a viral polyprotein, which later may be processed by proteolysis in vivo or in vitro to produce the desired pesticidal protein. It is also recognized that such a viral polyprotein, comprising at least a portion of the amino acid sequence of a pesticidal protein of the embodiments, may have the desired pesticidal activity. Such viral polyproteins and the nucleotide sequences that encode for them are encompassed by the embodiments. Methods for providing plants with nucleotide constructs and producing the encoded proteins in the plants, which involve viral DNA or RNA molecules are known in the art. See, for example, U.S. Pat. Nos. 5,889,191; 5,889,190; 5,866,785; 5,589,367; and 5,316,931; herein incorporated by reference.

The embodiments further relate to plant-propagating material of a transformed plant of the embodiments including, but not limited to, seeds, tubers, corms, bulbs, leaves, and cuttings of roots and shoots.

The embodiments may be used for transformation of any plant species, including, but not limited to, monocots and dicots. Examples of plants of interest include, but are not limited to, corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, barley, vegetables, ornamentals, and conifers.

Vegetables include tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*). Ornamentals include azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and *chrysanthemum*. Conifers that may be employed in practicing the embodiments include, for example, pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*); Douglas fir (*Pseudotsuga menziesii*); Western hemlock (*Tsuga canadensis*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*). Plants of the embodiments include crop plants, including, but not limited to: corn, alfalfa, sunflower, *Brassica* spp., soybean, cotton, safflower, peanut, sorghum, wheat, millet, tobacco, sugarcane, etc.

Turfgrasses include, but are not limited to: annual bluegrass (*Poa annua*); annual ryegrass (*Lolium multiflorum*); Canada bluegrass (*Poa compressa*); Chewings fescue (*Festuca rubra*); colonial bentgrass (*Agrostis tenuis*); creeping bentgrass (*Agrostis palustris*); crested wheatgrass (*Agropyron desertorum*); fairway wheatgrass (*Agropyron cristatum*); hard fescue (*Festuca longifolia*); Kentucky bluegrass (*Poa pratensis*); orchardgrass (*Dactylis glomerata*); perennial ryegrass (*Lolium perenne*); red fescue (*Festuca rubra*); redtop (*Agrostis alba*); rough bluegrass (*Poa trivialis*); sheep fescue (*Festuca ovina*); smooth bromegrass (*Bromus inermis*); tall fescue (*Festuca arundinacea*); timothy (*Phleum pratense*); velvet bentgrass (*Agrostis canina*); weeping alkaligrass (*Puccinellia distans*); western wheatgrass (*Agropyron smithii*); Bermuda grass (*Cynodon* spp.); St. Augustine grass (*Stenotaphrum secundatum*); zoysia grass (*Zoysia* spp.); Bahia grass (*Paspalum notatum*); carpet grass (*Axonopus affinis*); centipede grass (*Eremochloa ophiuroides*); kikuyu grass (*Pennisetum clandesinum*); seashore paspalum (*Paspalum vaginatum*); blue gramma (*Bouteloua gracilis*); buffalo grass (*Buchloe dactyloids*); sideoats gramma (*Bouteloua curtipendula*).

Plants of interest include grain plants that provide seeds of interest, oil-seed plants, and leguminous plants. Seeds of interest include grain seeds, such as corn, wheat, barley, rice, sorghum, rye, millet, etc. Oil-seed plants include cotton, soybean, safflower, sunflower, *Brassica*, maize, alfalfa, palm, coconut, flax, castor, olive etc. Leguminous plants include beans and peas. Beans include guar, locust bean, fenugreek, soybean, garden beans, cowpea, mung bean, lima bean, fava bean, lentils, chickpea, etc.

In certain embodiments the nucleic acid sequences of the embodiments can be stacked with any combination of polynucleotide sequences of interest in order to create plants with a desired phenotype. For example, the polynucleotides of the embodiments may be stacked with any other polynucleotides encoding polypeptides having pesticidal and/or insecticidal activity, including but are not limited to: insecticidal proteins from *Pseudomonas* sp. such as PSEEN3174 (Monalysin, (2011) *PLoS Pathogens,* 7:1-13), from *Pseudomonas protegens* strain CHAO and Pf-5 (previously *fluorescens*) (Pechy-Tarr, (2008) *Environmental Microbiology* 10:2368-2386: GenBank Accession No. EU400157); from *Pseudomonas Taiwanensis* (Liu, et al., (2010) *J. Agric. Food Chem.* 58:12343-12349) and from *Pseudomonas pseudoalcligenes* (Zhang, et al., (2009) *Annals of Microbiology* 59:45-50 and Li, et al., (2007) *Plant Cell Tiss. Organ Cult.* 89:159-168); insecticidal proteins from *Photorhabdus* sp. and *Xenorhabdus* sp. (Hinchliffe, et al., (2010) *The Open Toxinology Journal* 3:101-118 and Morgan, et al., (2001) *Applied and Envir. Micro.* 67:2062-2069), U.S. Pat. Nos. 6,048,838, and 6,379,946; a PIP-1 polypeptide of US Patent Publication US20140007292; an AflP-1A and/or AflP-1B polypeptide of US Patent Publication US20140033361; a PHI-4 polypeptide of US Patent Publication US20140274885 and US20160040184; a PIP-47 polypeptide of PCT Publication Number WO2015/023846, a PIP-72 polypeptide of PCT Publication Number WO2015/038734; a PtIP-50 polypeptide and a PtIP-65 polypeptide of PCT Publication Number WO2015/120270; a PtIP-83 polypeptide of PCT Publication Number WO2015/120276; a PtIP-96 polypeptide of PCT Serial Number PCT/US15/55502; an IPD079 polypeptide of U.S. Ser. No. 62/201,977; an IPD082 polypeptide of U.S. Ser. No. 62/269,482; and δ-endotoxins including, but not limited to, the Cry1, Cry2, Cry3, Cry4, Cry5, Cry6, Cry7, Cry8, Cry9, Cry10, Cry11, Cry12, Cry13, Cry14, Cry15, Cry16, Cry17, Cry18, Cry19, Cry20, Cry21, Cry22, Cry23, Cry24, Cry25, Cry26, Cry27, Cry 28, Cry 29, Cry 30, Cry31, Cry32, Cry33, Cry34, Cry35,Cry36, Cry37, Cry38, Cry39, Cry40, Cry41, Cry42, Cry43, Cry44, Cry45, Cry 46, Cry47, Cry49, Cry50, Cry51, Cry52, Cry53, Cry 54, Cry55, Cry56, Cry57, Cry58, Cry59, Cry60, Cry61, Cry62, Cry63, Cry64, Cry65, Cry66, Cry67, Cry68, Cry69, Cry70, Cry71, and Cry 72 classes of δ-endotoxin genes and the *B. thuringiensis* cytolytic Cyt1 and Cyt2 genes. Members of these classes of *B. thuringiensis* insecticidal proteins well known to one skilled in the art (see, Crickmore, et al., "Bacillus thuringiensis toxin nomenclature" (2011), at life-sci.sussex.ac.uk/home/Neil_Crickmore/Bt/which can be accessed on the world-wide web using the "www" prefix).

Examples of δ-endotoxins also include but are not limited to Cry1A proteins of U.S. Pat. Nos. 5,880,275 and 7,858,849; a DIG-3 or DIG-11 toxin (N-terminal deletion of α-helix 1 and/or α-helix 2 variants of Cry proteins such as Cry1A) of U.S. Pat. Nos. 8,304,604 and 8.304,605, Cry1B of U.S. patent application Ser. No. 10/525,318; Cry1C of U.S. Pat. No. 6,033,874; Cry1F of U.S. Pat. Nos. 5,188,960, 6,218,188; Cry1A/F chimeras of U.S. Pat. Nos. 7,070,982; 6,962,705 and 6,713,063); a Cry2 protein such as Cry2Ab protein of U.S. Pat. No. 7,064,249); a Cry3A protein including but not limited to an engineered hybrid insecticidal protein (eHIP) created by fusing unique combinations of variable regions and conserved blocks of at least two different Cry proteins (US Patent Application Publication Number 2010/0017914); a Cry4 protein; a Cry5 protein; a Cry6 protein; Cry8 proteins of U.S. Pat. Nos. 7,329,736, 7,449,552, 7,803,943, 7,476,781, 7,105,332, 7,378,499 and 7,462,760; a Cry9 protein such as such as members of the Cry9A, Cry9B, Cry9C, Cry9D, Cry9E, and Cry9F families; a Cry15 protein of Naimov, et al., (2008) *Applied and Environmental Microbiology* 74:7145-7151; a Cry22, a Cry34Ab1 protein of U.S. Pat. Nos. 6,127,180, 6,624,145 and 6,340,593; a CryET33 and CryET34 protein of U.S. Pat. Nos. 6,248,535, 6,326,351, 6,399,330, 6,949,626, 7,385,107 and 7,504,229; a CryET33 and CryET34 homologs of US Patent Publication Number 2006/0191034, 2012/0278954, and PCT Publication Number WO 2012/139004; a Cry35Ab1 protein of U.S. Pat. Nos. 6,083,499, 6,548,291 and 6,340,593; a Cry46 protein, a Cry 51 protein, a Cry binary toxin; a TIC901 or related toxin; TIC807 of US 2008/0295207; ET29, ET37, TIC809, TIC810, TIC812, TIC127, TIC128 of PCT US 2006/033867; AXMI-027, AXMI-036, and AXMI-038 of U.S. Pat. No. 8,236,757; AXMI-031, AXMI-039, AXMI-040, AXMI-049 of U.S. Pat. No. 7,923,602; AXMI-018, AXMI-020, and AXMI-021 of WO 2006/083891; AXMI-010 of WO 2005/038032; AXMI-003 of WO 2005/021585; AXMI-008 of US 2004/0250311; AXMI-006 of US 2004/0216186; AXMI-007 of US 2004/0210965; AXMI-009 of US 2004/0210964; AXMI-014 of US 2004/0197917; AXMI-004 of US 2004/0197916; AXMI-028 and AXMI-029 of WO 2006/119457; AXMI-007, AXMI-008, AXMI-0080rf2, AXMI-009, AXMI-014 and AXMI-004 of WO 2004/074462; AXMI-150 of U.S. Pat. No. 8,084,416; AXMI-205 of US20110023184; AXMI-011, AXMI-012, AXMI-013, AXMI-015, AXMI-019, AXMI-044, AXMI-037, AXMI-043, AXMI-033, AXMI-034, AXMI-022, AXMI-023, AXMI-041, AXMI-063, and AXMI-064 of US 2011/0263488; AXMI-R1 and related proteins of US 2010/0197592; AXMI221Z, AXMI222z, AXMI223z, AXMI224z and AXMI225z of WO 2011/103248; AXMI218, AXMI219, AXMI220, AXMI226, AXMI227, AXMI228, AXMI229, AXMI230, and AXMI231 of WO11/103247; AXMI-115, AXMI-113, AXMI-005, AXMI-163 and AXMI-184 of U.S. Pat. No. 8,334,431; AXMI-001, AXMI-002, AXMI-030, AXMI-035, and AXMI-045 of US 2010/0298211; AXMI-066 and AXMI-076 of US20090144852; AXMI128, AXMI130, AXMI131, AXMI133, AXMI140, AXMI141, AXMI142, AXMI143, AXMI144, AXMI146, AXMI148, AXMI149, AXMI152, AXMI153, AXMI154, AXMI155, AXMI156, AXMI157, AXMI158, AXMI162, AXMI165, AXMI166, AXMI167, AXMI168, AXMI169, AXMI170, AXMI171, AXMI172, AXMI173, AXMI174, AXMI175, AXMI176, AXMI177, AXMI178, AXMI179, AXMI180, AXMI181, AXMI182, AXMI185, AXMI186, AXMI187, AXMI188, AXMI189 of U.S. Pat. No. 8,318,900; AXMI0079, AXMI080, AXMI0081, AXMI0082, AXMI091, AXMI0092, AXMI0096, AXMI0097, AXMI0098, AXMI0099, AXMI100, AXMI101, AXMI102, AXMI103, AXMI104, AXMI107, AXMI108, AXMI109, AXMI110, AXMI111, AXMI112, AXMI114, AXMI116, AXMI117, AXMI118, AXMI119, AXMI120, AXMI121, AXMI122, AXMI123, AXMI124, AXMI257, AXMI268, AXMI127, AXMI129, AXMI164, AXMI151, AXMI161, AXMI183, AXMI132, AXMI138, AXMI137 of US 2010/0005543; and Cry proteins such as Cry1A and Cry3A having modified proteolytic sites of U.S. Pat. No. 8,319,019; and a Cry1Ac, Cry2Aa and Cry1Ca toxin protein from *Bacillus thuringiensis* strain VBTS 2528 of US Patent Application Publication Number 2011/0064710. Other Cry proteins are well known to one skilled in the art (see, Crickmore, et al., "*Bacillus thuringiensis* toxin nomenclature" (2011), at lifesci.sussex.ac.uk/home/Neil_Crickmore/Bt/which can be accessed on the world-wide web using the "www" prefix). The insecticidal activity of Cry proteins is well known to one skilled in the art (for review, see, van Frannkenhuyzen, (2009) *J. Invert. Path.* 101:1-16). The use of Cry proteins as transgenic plant traits is well known to one skilled in the art and Cry-transgenic plants including but not limited to Cry1Ac, Cry1Ac+Cry2Ab, Cry1Ab, Cry1A.105, Cry1F, Cry1Fa2, Cry1F+Cry1Ac, Cry2Ab, Cry3A, mCry3A, Cry3Bbl, Cry34Abl, Cry35Abl, Vip3A, mCry3A, Cry9c and CBI-Bt have received regulatory approval (see, Sanahuja, (2011) *Plant Biotech Journal* 9:283-300 and the CERA (2010) GM Crop Database Center for Environmental Risk Assessment (CERA), ILSI Research Foundation, Washington D.C. at cera-gmc.org/index.php?action=gm_crop_database which can be accessed on the world-wide web using the "www" prefix). More than one pesticidal proteins well known to one skilled in the art can also be expressed in plants such as Vip3Ab & Cry1Fa (US2012/0317682), Cry1BE & Cry1F (US2012/0311746), Cry1CA & Cry1AB (US2012/0311745), Cry1F & CryCa (US2012/0317681), Cry1DA & Cry1BE (US2012/0331590), Cry1DA & Cry1Fa (US2012/0331589), Cry1AB & Cry1BE (US2012/0324606), and Cry1Fa & Cry2Aa, Cry1I or Cry1E (US2012/0324605). Pesticidal proteins also include insecticidal lipases including lipid acyl hydrolases of U.S. Pat. No. 7,491,869, and cholesterol oxidases such as from *Streptomyces* (Purcell et al. (1993) *Biochem Biophys Res Commun* 15:1406-1413). Pesticidal proteins also include VIP (vegetative insecticidal proteins) toxins of U.S. Pat. Nos. 5,877,012, 6,107,279, 6,137,033, 7,244,820, 7,615,686, and 8,237,020, and the like. Other VIP proteins are well known to one skilled in the art (see, lifesci.sussex.ac.uk/home/Neil_Crickmore/Bt/vip.html which can be accessed on the world-wide web using the "www" prefix). Pesticidal proteins also include toxin complex (TC) proteins, obtainable from organisms such as *Xenorhabdus, Photorhabdus* and *Paenibacillus* (see, U.S. Pat. Nos. 7,491,698 and 8,084,418). Some TC proteins have "stand alone" insecticidal activity and other TC proteins enhance the activity of the stand-alone toxins produced by the same given organism. The toxicity of a "stand-alone" TC protein (from *Photorhabdus, Xenorhabdus* or *Paenibacillus*, for example) can be enhanced by one or more TC protein "potentiators" derived from a source organism of a different genus. There are three main types of TC proteins. As referred to herein, Class A proteins ("Protein A") are stand-alone toxins. Class B proteins ("Protein B") and Class C proteins ("Protein C") enhance the toxicity of Class A proteins. Examples of Class A proteins are TcbA, TcdA, XptAl and XptA2. Examples of Class B proteins are TcaC, TcdB, XptB1Xb and XptC1Wi. Examples of Class C proteins are TccC, XptC1Xb and XptB1Wi. Pesticidal proteins also include spider, snake and scorpion venom proteins. Examples of spider venom peptides include but are not limited to lycotoxin-1 peptides and mutants thereof (U.S. Pat. No. 8,334,366). The combinations generated can also include multiple copies of any one of the polynucleotides of interest. The polynucleotides of the embodiments can also be stacked with any other gene or combination of genes to produce plants with a variety of desired trait combinations including but not limited to traits desirable for animal feed such as high oil genes (e.g., U.S. Pat. No. 6,232,529); balanced amino acids (e.g. hordothionins (U.S. Pat. Nos. 5,990,389; 5,885,801; 5,885,802; and 5,703,049); barley high lysine (Williamson et al. (1987) *Eur. J. Biochem.* 165: 99-106; and WO 98/20122) and high methionine proteins (Pedersen et al. (1986) *J. Biol. Chem.* 261: 6279; Kirihara et al. (1988) *Gene* 71: 359; and Musumura et al. (1989) *Plant Mol. Biol.* 12: 123)); increased digestibility (e.g., modified storage proteins (U.S. Pat. No. 6,858,778); and thioredoxins (U.S. Pat. No. 7,009,087), the disclosures of which are herein incorporated by reference.

The polynucleotides of the embodiments can also be stacked with traits desirable for disease or herbicide resistance (e.g., fumonisin detoxification genes (U.S. Pat. No. 5,792,931); avirulence and disease resistance genes (Jones et al. (1994) *Science* 266:789; Martin et al. (1993) *Science* 262: 1432; and Mindrinos et al. (1994) *Cell* 78:1089); acetolactate synthase (ALS) mutants that lead to herbicide resistance such as the S4 and/or Hra mutations); inhibitors of glutamine synthase such as phosphinothricin or basta (e.g., bar gene); and glyphosate resistance (EPSPS gene and GAT gene as disclosed in U.S. Pat. Nos. 7,709,702; and 7,462,481; and traits desirable for processing or process products such as high oil (e.g., U.S. Pat. No. 6,232,529); modified oils (e.g., fatty acid desaturase genes (U.S. Pat. No. 5,952,544; WO 94/11516)); modified starches (e.g., ADPG pyrophosphorylases (AGPase), starch synthases (SS), starch branching enzymes (SBE) and starch debranching enzymes (SDBE)); and polymers or bioplastics (e.g., U.S. Pat. No. 5,602,321; beta-ketothiolase, polyhydroxybutyrate synthase, and acetoacetyl-CoA reductase (Schubert et al. (1988) *J. Bacteriol.* 170: 5837-5847) facilitate expression of polyhydroxyalkanoates (PHAs)), the disclosures of which are herein incorporated by reference. One could also combine the polynucleotides of the embodiments with polynucleotides providing agronomic traits such as male sterility (e.g., see U.S. Pat. No. 5,583,210), stalk strength, flowering time, or transformation technology traits such as cell cycle regulation or gene targeting (e.g. WO 99/61619; WO 00/17364; WO 99/25821), the disclosures of which are herein incorporated by reference.

In some embodiment the stacked trait may be a trait or event that has received regulatory approval which are well known to one skilled in the art and can be found at the Center for Environmental Risk Assessment (cera-gmc.org/?action=gm_crop_database, which can be accessed using the www prefix) and at the International Service for the Acquisition of Agri-Biotech Applications isaaa.org/gmapprovaldatabase/default.asp, which can be accessed using the www prefix).

These stacked combinations can be created by any method including but not limited to cross breeding plants by any conventional or TOPCROSS® methodology, or genetic transformation. If the traits are stacked by genetically transforming the plants, the polynucleotide sequences of interest can be combined at any time and in any order. For example, a transgenic plant comprising one or more desired traits can be used as the target to introduce further traits by subsequent transformation. The traits can be introduced simultaneously in a co-transformation protocol with the polynucleotides of interest provided by any combination of transformation cassettes. For example, if two sequences will be introduced, the two sequences can be contained in separate transformation cassettes (trans) or contained on the same transformation cassette (cis). Expression of the sequences can be driven by the same promoter or by different promoters. In certain cases, it may be desirable to introduce a transformation cassette that will suppress the expression of the polynucleotide of interest. This may be combined with any combination of other suppression cassettes or overexpression cassettes to generate the desired combination of traits in the plant. It is further recognized that polynucleotide sequences can be stacked at a desired genomic location using a site-specific recombination system. See, for example, WO99/25821, WO99/25854, WO99/25840, WO99/25855, and WO99/25853, all of which are herein incorporated by reference.

Compositions of the embodiments find use in protecting plants, seeds, and plant products in a variety of ways. For example, the compositions can be used in a method that involves placing an effective amount of the pesticidal composition in the environment of the pest by a procedure selected from the group consisting of spraying, dusting, broadcasting, or seed coating.

Before plant propagation material (fruit, tuber, bulb, corm, grains, seed), but especially seed, is sold as a commercial product, it is customarily treated with a protectant coating comprising herbicides, insecticides, fungicides, bactericides, nematicides, molluscicides, or mixtures of several of these preparations, if desired together with further carriers, surfactants, or application-promoting adjuvants customarily employed in the art of formulation to provide protection against damage caused by bacterial, fungal, or animal pests. In order to treat the seed, the protectant coating may be applied to the seeds either by impregnating the tubers or grains with a liquid formulation or by coating them with a combined wet or dry formulation. In addition, in special cases, other methods of application to plants are possible, e.g., treatment directed at the buds or the fruit.

The plant seed of the embodiments comprising a nucleotide sequence encoding a pesticidal protein of the embodiments may be treated with a seed protectant coating comprising a seed treatment compound, such as, for example, captan, carboxin, thiram, methalaxyl, pirimiphos-methyl, and others that are commonly used in seed treatment. In one embodiment, a seed protectant coating comprising a pesticidal composition of the embodiments is used alone or in combination with one of the seed protectant coatings customarily used in seed treatment.

It is recognized that the genes encoding the pesticidal proteins can be used to transform insect pathogenic organisms. Such organisms include baculovirus, fungi, protozoa, bacteria, and nematodes.

A gene encoding a pesticidal protein of the embodiments may be introduced via a suitable vector into a microbial host, and said host applied to the environment, or to plants or animals. The term "introduced" in the context of inserting a nucleic acid into a cell, means "transfection" or "transformation" or "transduction" and includes reference to the incorporation of a nucleic acid into a eukaryotic or prokaryotic cell where the nucleic acid may be incorporated into the genome of the cell (e.g., chromosome, plasmid, plastid, or mitochondrial DNA), converted into an autonomous replicon, or transiently expressed (e.g., transfected mRNA).

Microorganism hosts that are known to occupy the "phytosphere" (phylloplane, phyllosphere, rhizosphere, and/or rhizoplana) of one or more crops of interest may be selected. These microorganisms are selected so as to be capable of successfully competing in the particular environment with the wild-type microorganisms, provide for stable maintenance and expression of the gene expressing the pesticidal protein, and desirably, provide for improved protection of the pesticide from environmental degradation and inactivation.

Such microorganisms include bacteria, algae, and fungi. Of particular interest are microorganisms such as bacteria, e.g., *Pseudomonas, Erwinia, Serratia, Klebsiella, Xanthomonas, Streptomyces, Rhizobium, Rhodopseudomonas, Methylius, Agrobacterium, Acetobacter, Lactobacillus, Arthrobacter, Azotobacter, Leuconostoc,* and *Alcaligenes,* fungi, particularly yeast, e.g., *Saccharomyces, Cryptococcus, Kluyveromyces, Sporobolomyces, Rhodotorula,* and *Aureobasidium.* Of particular interest are such phytosphere bacterial species as *Pseudomonas syringae, Pseudomonas fluorescens, Serratia marcescens, Acetobacter xylinum,* Agrobacteria, *Rhodopseudomonas spheroides, Xanthomonas campestris, Rhizobium melioti, Alcaligenes entrophus, Clavibacter xyli* and *Azotobacter vinelandii* and phytosphere yeast species such as *Rhodotorula rubra, R. glutinis, R. marina, R. aurantiaca, Cryptococcus albidus, C. diffluens, C. laurentii, Saccharomyces rosei, S. pretoriensis, S. cerevisiae, Sporobolomyces roseus, S. odorus, Kluyveromyces veronae,* and *Aureobasidium* pollulans. Of particular interest are the pigmented microorganisms.

A number of ways are available for introducing a gene expressing the pesticidal protein into the microorganism host under conditions that allow for stable maintenance and expression of the gene. For example, expression cassettes can be constructed which include the nucleotide constructs of interest operably linked with the transcriptional and translational regulatory signals for expression of the nucleotide constructs, and a nucleotide sequence homologous with a sequence in the host organism, whereby integration will occur, and/or a replication system that is functional in the host, whereby integration or stable maintenance will occur.

Transcriptional and translational regulatory signals include, but are not limited to, promoters, transcriptional initiation start sites, operators, activators, enhancers, other regulatory elements, ribosomal binding sites, an initiation codon, termination signals, and the like. See, for example, U.S. Pat. Nos. 5,039,523 and 4,853,331; EPO 0480762A2; Sambrook; Maniatis et al. (Cold Spring Harbor Laboratory Press, Cold Spring Harbor, N.Y.); Davis et al., eds. (1980) *Advanced Bacterial Genetics* (Cold Spring Harbor Laboratory Press, Cold Spring Harbor, N.Y.) and the references cited therein.

Suitable host cells, where the pesticidal protein-containing cells will be treated to prolong the activity of the pesticidal proteins in the cell when the treated cell is applied to the environment of the target pest(s), may include either prokaryotes or eukaryotes, normally being limited to those cells that do not produce substances toxic to higher organisms, such as mammals. However, organisms that produce substances toxic to higher organisms could be used, where the toxin is unstable or the level of application sufficiently low as to avoid any possibility of toxicity to a mammalian host. As hosts, of particular interest will be the prokaryotes and the lower eukaryotes, such as fungi. Illustrative prokaryotes, both Gram-negative and gram-positive, include Enterobacteriaceae, such as *Escherichia, Erwinia, Shigella, Salmonella,* and *Proteus*; Bacillaceae; Rhizobiaceae, such as *Rhizobium*; Spirillaceae, such as photobacterium, *Zymomonas, Serratia, Aeromonas, Vibrio, Desulfovibrio, Spirillum;* Lactobacillaceae; Pseudomonadaceae, such as *Pseudomonas* and *Acetobacter,* Azotobacteraceae and Nitrobacteraceae. Among eukaryotes are fungi, such as Phycomycetes and Ascomycetes, which includes yeast, such as *Saccharomyces* and *Schizosaccharomyces*; and Basidiomycetes yeast, such as *Rhodotorula, Aureobasidium*, Sporobolomyces, and the like.

Characteristics of particular interest in selecting a host cell for purposes of pesticidal protein production include ease of introducing the pesticidal protein gene into the host, availability of expression systems, efficiency of expression, stability of the protein in the host, and the presence of auxiliary genetic capabilities. Characteristics of interest for use as a pesticide microcapsule include protective qualities for the pesticide, such as thick cell walls, pigmentation, and intracellular packaging or formation of inclusion bodies; leaf affinity; lack of mammalian toxicity; attractiveness to pests for ingestion; ease of killing and fixing without damage to the toxin; and the like. Other considerations include ease of formulation and handling, economics, storage stability, and the like.

Host organisms of particular interest include yeast, such as *Rhodotorula* spp., *Aureobasidium* spp., *Saccharomyces* spp. (such as *S. cerevisiae*), *Sporobolomyces* spp., phylloplane organisms such as *Pseudomonas* spp. (such as *P. aeruginosa, P. fluorescens*), *Erwinia* spp., and *Flavobacterium* spp., and other such organisms, including Bt, *E. coli, Bacillus subtilis*, and the like.

Genes encoding the pesticidal proteins of the embodiments can be introduced into microorganisms that multiply on plants (epiphytes) to deliver pesticidal proteins to potential target pests. Epiphytes, for example, can be gram-positive or gram-negative bacteria.

Root-colonizing bacteria, for example, can be isolated from the plant of interest by methods known in the art. Specifically, a *Bacillus cereus* strain that colonizes roots can be isolated from roots of a plant (see, for example, Handelsman et al. (1991) *Appl. Environ. Microbiol.* 56:713-718). Genes encoding the pesticidal proteins of the embodiments can be introduced into a root-colonizing *Bacillus cereus* by standard methods known in the art.

Genes encoding pesticidal proteins can be introduced, for example, into the root-colonizing *Bacillus* by means of electro transformation. Specifically, genes encoding the pesticidal proteins can be cloned into a shuttle vector, for example, pHT3101 (Lerecius et al. (1989) *FEMS Microbiol. Letts.* 60: 211-218. The shuttle vector pHT3101 containing the coding sequence for the particular pesticidal protein gene can, for example, be transformed into the root-colonizing *Bacillus* by means of electroporation (Lerecius et al. (1989) *FEMS Microbiol. Letts.* 60: 211-218).

Expression systems can be designed so that pesticidal proteins are secreted outside the cytoplasm of gram-negative bacteria, such as *E. coli*, for example. Advantages of having pesticidal proteins secreted are: (1) avoidance of potential cytotoxic effects of the pesticidal protein expressed; and (2) improvement in the efficiency of purification of the pesticidal protein, including, but not limited to, increased efficiency in the recovery and purification of the protein per volume cell broth and decreased time and/or costs of recovery and purification per unit protein.

Pesticidal proteins can be made to be secreted in *E. coli*, for example, by fusing an appropriate *E. coli* signal peptide to the amino-terminal end of the pesticidal protein. Signal peptides recognized by *E. coli* can be found in proteins already known to be secreted in *E. coli*, for example the OmpA protein (Ghrayeb et al. (1984) *EMBO J*, 3:2437-2442). OmpA is a major protein of the *E. coli* outer membrane, and thus its signal peptide is thought to be efficient in the translocation process. Also, the OmpA signal peptide does not need to be modified before processing as may be the case for other signal peptides, for example lipoprotein signal peptide (Duffaud et al. (1987) *Meth. Enzymol.* 153: 492).

Pesticidal proteins of the embodiments can be fermented in a bacterial host and the resulting bacteria processed and used as a microbial spray in the same manner that Bt strains have been used as insecticidal sprays. In the case of a pesticidal protein(s) that is secreted from *Bacillus*, the secretion signal is removed or mutated using procedures known in the art. Such mutations and/or deletions prevent secretion of the pesticidal protein(s) into the growth medium during the fermentation process. The pesticidal proteins are retained within the cell, and the cells are then processed to yield the encapsulated pesticidal proteins. Any suitable microorganism can be used for this purpose. *Pseudomonas* has been used to express Bt toxins as encapsulated proteins and the resulting cells processed and sprayed as an insecticide (Gaertner et al. (1993), in: *Advanced Engineered Pesticides*, ed. Kim).

Alternatively, the pesticidal proteins are produced by introducing a heterologous gene into a cellular host. Expression of the heterologous gene results, directly or indirectly, in the intracellular production and maintenance of the pesticide. These cells are then treated under conditions that prolong the activity of the toxin produced in the cell when the cell is applied to the environment of target pest(s). The resulting product retains the toxicity of the toxin. These naturally encapsulated pesticidal proteins may then be formulated in accordance with conventional techniques for application to the environment hosting a target pest, e.g., soil, water, and foliage of plants. See, for example EP0192319, and the references cited therein.

In the embodiments, a transformed microorganism (which includes whole organisms, cells, spore(s), pesticidal protein(s), pesticidal component(s), pest-impacting component(s), mutant(s), living or dead cells and cell components, including mixtures of living and dead cells and cell components, and including broken cells and cell components) or an isolated pesticidal protein can be formulated with an acceptable carrier into a pesticidal composition(s) that is, for example, a suspension, a solution, an emulsion, a dusting powder, a dispersible granule or pellet, a wettable powder, and an emulsifiable concentrate, an aerosol or spray, an impregnated granule, an adjuvant, a coatable paste, a colloid, and also encapsulations in, for example, polymer substances. Such formulated compositions may be prepared by such conventional means as desiccation, lyophilization, homogenization, extraction, filtration, centrifugation, sedimentation, or concentration of a culture of cells comprising the polypeptide.

Such compositions disclosed above may be obtained by the addition of a surface-active agent, an inert carrier, a preservative, a humectant, a feeding stimulant, an attractant, an encapsulating agent, a binder, an emulsifier, a dye, a UV protectant, a buffer, a flow agent or fertilizers, micronutrient donors, or other preparations that influence plant growth. One or more agrochemicals including, but not limited to, herbicides, insecticides, fungicides, bactericides, nematicides, molluscicides, acaricides, plant growth regulators, harvest aids, and fertilizers, can be combined with carriers, surfactants or adjuvants customarily employed in the art of formulation or other components to facilitate product handling and application for particular target pests. Suitable carriers and adjuvants can be solid or liquid and correspond to the substances ordinarily employed in formulation technology, e.g., natural or regenerated mineral substances, solvents, dispersants, wetting agents, tackifiers, binders, or fertilizers. The active ingredients of the embodiments are normally applied in the form of compositions and can be applied to the crop area, plant, or seed to be treated. For example, the compositions of the embodiments may be applied to grain in preparation for or during storage in a grain bin or silo, etc. The compositions of the embodiments may be applied simultaneously or in succession with other compounds. Methods of applying an active ingredient of the embodiments or an agrochemical composition of the embodiments that contains at least one of the pesticidal proteins produced by the bacterial strains of the embodiments include, but are not limited to, foliar application, seed coating, and soil application. The number of applications and the rate of application depend on the intensity of infestation by the corresponding pest.

Suitable surface-active agents include, but are not limited to, anionic compounds such as a carboxylate of, for example, a metal; a carboxylate of a long chain fatty acid; an N-acylsarcosinate; mono or di-esters of phosphoric acid with fatty alcohol ethoxylates or salts of such esters; fatty alcohol sulfates such as sodium dodecyl sulfate, sodium octadecyl sulfate or sodium cetyl sulfate; ethoxylated fatty alcohol sulfates; ethoxylated alkylphenol sulfates; lignin sulfonates; petroleum sulfonates; alkyl aryl sulfonates such as alkyl-benzene sulfonates or lower alkylnaphtalene sulfonates, e.g., butyl-naphthalene sulfonate; salts of sulfonated naphthalene-formaldehyde condensates; salts of sulfonated phenol-formaldehyde condensates; more complex sulfonates such as the amide sulfonates, e.g., the sulfonated condensation product of oleic acid and N-methyl taurine; or the dialkyl sulfosuccinates, e.g., the sodium sulfonate of dioctyl succinate. Non-ionic agents include condensation products of fatty acid esters, fatty alcohols, fatty acid amides or fatty-alkyl- or alkenyl-substituted phenols with ethylene oxide, fatty esters of polyhydric alcohol ethers, e.g., sorbitan fatty acid esters, condensation products of such esters with ethylene oxide, e.g., polyoxyethylene sorbitar fatty acid esters, block copolymers of ethylene oxide and propylene oxide, acetylenic glycols such as 2,4,7,9-tetraethyl-5-decyn-4,7-diol, or ethoxylated acetylenic glycols. Examples of a cationic surface-active agent include, for instance, an aliphatic mono-, di-, or polyamine such as an acetate, naphthenate or oleate; or oxygen-containing amine such as an amine oxide of polyoxyethylene alkylamine; an amide-linked amine prepared by the condensation of a carboxylic acid with a di- or polyamine; or a quaternary ammonium salt.

Examples of inert materials include but are not limited to inorganic minerals such as kaolin, phyllosilicates, carbonates, sulfates, phosphates, or botanical materials such as cork, powdered corncobs, peanut hulls, rice hulls, and walnut shells.

The compositions of the embodiments can be in a suitable form for direct application or as a concentrate of primary composition that requires dilution with a suitable quantity of water or other diluent before application. The pesticidal concentration will vary depending upon the nature of the particular formulation, specifically, whether it is a concentrate or to be used directly. The composition contains 1 to 98% of a solid or liquid inert carrier, and 0 to 50% or 0.1 to 50% of a surfactant. These compositions will be administered at the labeled rate for the commercial product, for example, about 0.01 lb-5.0 lb. per acre when in dry form and at about 0.01 pts.-10 pts. per acre when in liquid form.

In a further embodiment, the compositions, as well as the transformed microorganisms and pesticidal proteins of the embodiments, can be treated prior to formulation to prolong the pesticidal activity when applied to the environment of a target pest as long as the pretreatment is not deleterious to the pesticidal activity. Such treatment can be by chemical and/or physical means as long as the treatment does not deleteriously affect the properties of the composition(s). Examples of chemical reagents include but are not limited to halogenating agents; aldehydes such as formaldehyde and glutaraldehyde; anti-infectives, such as zephiran chloride; alcohols, such as isopropanol and ethanol; and histological fixatives, such as Bouin's fixative and Helly's fixative (see, for example, Humason (1967) *Animal Tissue Techniques* (W.H. Freeman and Co.).

In other embodiments, it may be advantageous to treat the Cry toxin polypeptides with a protease, for example trypsin, to activate the protein prior to application of a pesticidal protein composition of the embodiments to the environment of the target pest. Methods for the activation of protoxin by a serine protease are well known in the art. See, for example, Cooksey (1968) *Biochem. J.* 6:445-454 and Carroll and Ellar (1989) *Biochem. J.* 261:99-105, the teachings of which are herein incorporated by reference. For example, a suitable activation protocol includes, but is not limited to, combining a polypeptide to be activated, for example a purified novel Cry polypeptide (e.g., having the amino acid sequence set forth in SEQ ID NO: 4 or SEQ ID NO: 8, and trypsin at a 1/100 weight ratio of protein/trypsin in 20 nM $NaHCO_3$, pH 8 and digesting the sample at 36° C. for 3 hours.

The compositions (including the transformed microorganisms and pesticidal proteins of the embodiments) can be applied to the environment of an insect pest by, for example, spraying, atomizing, dusting, scattering, coating or pouring, introducing into or on the soil, introducing into irrigation water, by seed treatment or general application or dusting at the time when the pest has begun to appear or before the appearance of pests as a protective measure. For example, the pesticidal protein and/or transformed microorganisms of the embodiments may be mixed with grain to protect the grain during storage. It is generally important to obtain good control of pests in the early stages of plant growth, as this is the time when the plant can be most severely damaged. The compositions of the embodiments can conveniently contain another insecticide if this is thought necessary. In one embodiment, the composition is applied directly to the soil, at a time of planting, in granular form of a composition of a carrier and dead cells of a *Bacillus* strain or transformed microorganism of the embodiments. Another embodiment is a granular form of a composition comprising an agrochemical such as, for example, an herbicide, an insecticide, a fertilizer, an inert carrier, and dead cells of a *Bacillus* strain or transformed microorganism of the embodiments.

Those skilled in the art will recognize that not all compounds are equally effective against all pests. Compounds of the embodiments display activity against insect pests, which may include economically important agronomic, forest, greenhouse, nursery, ornamentals, food and fiber, public and animal health, domestic and commercial structure, household, and stored product pests. Insect pests include insects selected from the orders Coleoptera, Diptera, Hymenoptera, Lepidoptera, Mallophaga, Homoptera, Hemiptera, Orthoptera, Thysanoptera, Dermaptera, Isoptera, Anoplura, Siphonaptera, Trichoptera, etc., particularly Coleoptera and Lepidoptera.

Insects of the order Lepidoptera include, but are not limited to, armyworms, cutworms, loopers, and heliothines in the family Noctuidae: *Agrotis ipsilon* Hufnagel (black cutworm); *A. orthogonia* Morrison (western cutworm); *A.*

*segetum* Denis & Schiffermiller (turnip moth); *A. subterranea* Fabricius (granulate cutworm); *Alabama argillacea* Hübner (cotton leaf worm); *Anticarsia gemmatalis* Hübner (velvetbean caterpillar); *Athetis mindara* Barnes and McDunnough (rough skinned cutworm); *Earias insulana* Boisduval (spiny bollworm); *E. vittella* Fabricius (spotted bollworm); Egira (Xylomyges) *curialis* Grote (citrus cutworm); *Euxoa messoria* Harris (darksided cutworm); *Helicoverpa armigera* Hübner (American bollworm); *H. zea* Boddie (corn earworm or cotton bollworm); *Heliothis virescens* Fabricius (tobacco budworm); *Hypena scabra* Fabricius (green cloverworm); *Mamestra configurata* Walker (bertha armyworm); *M. brassicae* Linnaeus (cabbage moth); *Melanchra picta* Harris (zebra caterpillar); *Pseudaletia unipuncta* Haworth (armyworm); *Pseudoplusia includens* Walker (soybean looper); *Richia albicosta* Smith (Western bean cutworm); *Spodoptera frugiperda* JE Smith (fall armyworm); *S. exigua* Hübner (beet armyworm); *S. litura* Fabricius (tobacco cutworm, cluster caterpillar); *Trichoplusia ni* Hübner (cabbage looper); borers, casebearers, webworms, coneworms, and skeletonizers from the families Pyralidae and Crambidae such as *Achroia grisella* Fabricius (lesser wax moth); *Amyelois transitella* Walker (naval orangeworm); *Anagasta kuehniella* Zeller (Mediterranean flour moth); *Cadra cautella* Walker (almond moth); *Chilo partellus* Swinhoe (spotted stalk borer); *C. suppressalis* Walker (striped stem/rice borer); *C. terrenellus* Pagenstecher (sugarcane stemp borer); *Corcyra cephalonica* Stainton (rice moth); *Crambus caliginosellus* Clemens (corn root webworm); *C. teterrellus* Zincken (bluegrass webworm); *Cnaphalocrocis medinalis* Guenée (rice leaf roller); *Desmia funeralis* Hübner (grape leaffolder); *Diaphania hyalinata* Linnaeus (melon worm); *D. nitidalis* Stoll (pickleworm); *Diatraea grandiosella* Dyar (southwestern corn borer), *D. saccharalis* Fabricius (surgarcane borer); *Elasmopalpus lignosellus* Zeller (lesser cornstalk borer); *Eoreuma loftini* Dyar (Mexican rice borer); *Ephestia elutella* Hübner (tobacco (cacao) moth); *Galleria mellonella* Linnaeus (greater wax moth); *Hedylepta accepta* Butler (sugarcane leafroller); *Herpetogramma licarsisalis* Walker (sod webworm); *Homoeosoma electellum* Hulst (sunflower moth); *Loxostege sticticalis* Linnaeus (beet webworm); *Maruca testulalis* Geyer (bean pod borer); *Orthaga thyrisalis* Walker (tea tree web moth); *Ostrinia nubilalis* Hübner (European corn borer); *Plodia interpunctella* Hübner (Indian meal moth); *Scirpophaga incertulas* Walker (yellow stem borer); *Udea rubigalis* Guenée (celery leaftier); and leafrollers, budworms, seed worms, and fruit worms in the family Tortricidae *Acleris gloverana* Walsingham (Western blackheaded budworm); *A. variana* Fernald (Eastern blackheaded budworm); *Adoxophyes orana* Fischer von Rosslerstamm (summer fruit *tortrix* moth); *Archips* spp. including *A. argyrospila* Walker (fruit tree leaf roller) and *A. rosana* Linnaeus (European leaf roller); *Argyrotaenia* spp.; *Bonagota salubricola* Meyrick (Brazilian apple leafroller); *Choristoneura* spp.; *Cochylis hospes* Walsingham (banded sunflower moth); *Cydia latiferreana* Walsingham (filbertworm); *C. pomonella* Linnaeus (codling moth); *Endopiza viteana* Clemens (grape berry moth); *Eupoecilia ambiguella* Hübner (vine moth); *Grapholita molesta* Busck (oriental fruit moth); *Lobesia botrana* Denis & Schiffermiller (European grape vine moth); *Platynota flavedana* Clemens (variegated leafroller); *P. stultana* Walsingham (omnivorous leafroller); *Spilonota ocellana* Denis & Schiffermiller (eyespotted bud moth); and *Suleima helianthana* Riley (sunflower bud moth).

Selected other agronomic pests in the order Lepidoptera include, but are not limited to, *Alsophila pometaria* Harris (fall cankerworm); *Anarsia lineatella* Zeller (peach twig borer); *Anisota senatoria* J. E. Smith (orange striped oakworm); *Antheraea pernyi* Guerin-Meneville (Chinese Oak Silkmoth); *Bombyx mori* Linnaeus (Silkworm); *Bucculatrix thurberiella* Busck (cotton leaf perforator); *Colias eurytheme* Boisduval (alfalfa caterpillar); *Datana integerrima* Grote & Robinson (walnut caterpillar); *Dendrolimus sibiricus* Tschetwerikov (Siberian silk moth), *Ennomos subsignaria* Hübner (elm spanworm); *Erannis tiliaria* Harris (linden looper); *Erechthias flavistriata* Walsingham (sugarcane bud moth); *Euproctis chrysorrhoea* Linnaeus (browntail moth); *Harrisina americana* Guerin-Meneville (grapeleaf skeletonizer); *Heliothis subflexa* Guenée; *Hemileuca oliviae* Cockrell (range caterpillar); *Hyphantria cunea* Drury (fall webworm); *Keiferia lycopersicella* Walsingham (tomato pinworm); *Lambdina fiscellaria fiscellaria* Hulst (Eastern hemlock looper); *L. fiscellaria lugubrosa* Hulst (Western hemlock looper); *Leucoma salicis* Linnaeus (satin moth); *Lymantria dispar* Linnaeus (gypsy moth); *Malacosoma* spp.; *Manduca quinquemaculata* Haworth (five spotted hawk moth, tomato hornworm); *M. sexta* Haworth (tomato hornworm, tobacco hornworm); *Operophtera brumata* Linnaeus (winter moth); *Orgyia* spp.; *Paleacrita vernata* Peck (spring cankerworm); *Papilio cresphontes* Cramer (giant swallowtail, orange dog); *Phryganidia californica* Packard (California oakworm); *Phyllocnistis citrella* Stainton (citrus leafminer); *Phyllonorycter blancardella* Fabricius (spotted tentiform leafminer); *Pieris brassicae* Linnaeus (large white butterfly); *P. rapae* Linnaeus (small white butterfly); *P. napi* Linnaeus (green veined white butterfly); *Platyptilia carduidactyla* Riley (artichoke plume moth); *Plutella xylostella* Linnaeus (diamondback moth); *Pectinophora gossypiella* Saunders (pink bollworm); *Pontia protodice* Boisduval & Leconte (Southern cabbageworm); *Sabulodes aegrotata* Guenée (omnivorous looper); *Schizura concinna* J. E. Smith (red humped caterpillar); *Sitotroga cerealella* Olivier (Angoumois grain moth); *Thaumetopoea pityocampa* Schiffermuller (pine processionary caterpillar); *Tineola bisselliella* Hummel (webbing clothesmoth); *Tuta absoluta* Meyrick (tomato leafminer) and *Yponomeuta padella* Linnaeus (ermine moth).

Of interest are larvae and adults of the order Coleoptera including weevils from the families Anthribidae, Bruchidae, and Curculionidae including, but not limited to: *Anthonomus grandis* Boheman (boll weevil); *Cylindrocopturus adspersus* LeConte (sunflower stem weevil); *Diaprepes abbreviatus* Linnaeus (Diaprepes root weevil); *Hypera punctata* Fabricius (clover leaf weevil); *Lissorhoptrus oryzophilus* Kuschel (rice water weevil); *Metamasius hemipterus hemipterus* Linnaeus (West Indian cane weevil); *M. hemipterus sericeus* Olivier (silky cane weevil); *Sitophilus granarius* Linnaeus (granary weevil); *S. oryzae* Linnaeus (rice weevil); *Smicronyx fulvus* LeConte (red sunflower seed weevil); *S. sordidus* LeConte (gray sunflower seed weevil); *Sphenophorus maidis* Chittenden (maize billbug); *Rhabdoscelus obscurus* Boisduval (New Guinea sugarcane weevil); flea beetles, cucumber beetles, rootworms, leaf beetles, potato beetles, and leafminers in the family Chrysomelidae including, but not limited to: *Chaetocnema ectypa* Horn (desert corn flea beetle); *C. pulicaria* Melsheimer (corn flea beetle); *Colaspis brunnea* Fabricius (grape *colaspis*); *Diabrotica barberi* Smith & Lawrence (northern corn rootworm); *D. undecimpunctata howardi* Barber (southern corn rootworm); *D. virgifera virgifera* LeConte (western corn rootworm); *Leptinotarsa decemlineata* Say (Colorado potato beetle); *Oulema melanopus* Linnaeus (cereal leaf beetle); *Phyllotreta cruciferae* Goeze (corn flea beetle); *Zygogramma exclamationis* Fabricius (sunflower beetle); beetles from the family Coccinellidae including, but not limited to: *Epilachna varivestis* Mulsant (Mexican bean beetle); chafers and other beetles from the family Scarabaeidae including, but not limited to: *Antitrogus parvulus* Britton (Childers cane grub); *Cyclocephala borealis* Arrow (northern masked chafer, white grub); *C. immaculata* Olivier (southern masked chafer, white grub); *Dermolepida albohirtum* Waterhouse (Greyback cane beetle); *Euetheola humilis* rugiceps LeConte (sugarcane beetle); *Lepidiota frenchi* Blackburn (French's cane grub); *Tomarus gibbosus* De Geer (carrot beetle); *T. subtropicus* Blatchley (sugarcane grub); *Phyllophaga crinita* Burmeister (white grub); *P. latifrons* LeConte (June beetle); *Popillia japonica* Newman (Japanese beetle); *Rhizotrogus majalis* Razoumowsky (European chafer); carpet beetles from the family Dermestidae; wireworms from the family Elateridae, *Eleodes* spp., *Melanotus* spp. including *M. communis* Gyllenhal (wireworm); *Conoderus* spp.; *Limonius* spp.; *Agriotes* spp.; *Ctenicera* spp.; *Aeolus* spp.; bark beetles from the family Scolytidae; beetles from the family Tenebrionidae; beetles from the family Cerambycidae such as, but not limited to, *Migdolus fryanus* Westwood (longhorn beetle); and beetles from the Buprestidae family including, but not limited to, *Aphanisticus cochinchinae seminulum* Obenberger (leaf-mining buprestid beetle).

Adults and immatures of the order Diptera are of interest, including leafminers Agromyza parvicornis Loew (corn blotch leafminer); midges including, but not limited to: *Contarinia sorghicola* Coquillett (sorghum midge); *Mayetiola destructor* Say (Hessian fly); *Neolasioptera murtfeldtiana* Felt, (sunflower seed midge); *Sitodiplosis mosellana* Géhin (wheat midge); fruit flies (Tephritidae), *Oscinella frit* Linnaeus (frit flies); maggots including, but not limited to: *Delia* spp. including *Delia platura* Meigen (seedcorn maggot); *D. coarctata* Fallen (wheat bulb fly); *Fannia canicularis* Linnaeus, *F. femoralis* Stein (lesser house flies); *Meromyza americana* Fitch (wheat stem maggot); *Musca domestica* Linnaeus (house flies); *Stomoxys calcitrans* Linnaeus (stable flies)); face flies, horn flies, blow flies, *Chrysomya* spp.; *Phormia* spp.; and other muscoid fly pests, horse flies *Tabanus* spp.; bot flies *Gastrophilus* spp.; *Oestrus* spp.; cattle grubs *Hypoderma* spp.; deer flies *Chrysops* spp.; *Melophagus ovinus* Linnaeus (keds); and other Brachycera, mosquitoes *Aedes* spp.; *Anopheles* spp.; *Culex* spp.; black flies *Prosimulium* spp.; *Simulium* spp.; biting midges, sand flies, sciarids, and other *Nematocera*.

Included as insects of interest are those of the order Hemiptera such as, but not limited to, the following families: Adelgidae, Aleyrodidae, Aphididae, Asterolecaniidae, Cercopidae, Cicadellidae, Cicadidae, Cixiidae, Coccidae, Coreidae, Dactylopiidae, Delphacidae, Diaspididae, Eriococcidae, Flatidae, Fulgoridae, Issidae, Lygaeidae, Margarodidae, Membracidae, Miridae, Ortheziidae, Pentatomidae, Phoenicococcidae, Phylloxeridae, Pseudococcidae, Psyllidae, Pyrrhocoridae and Tingidae.

Agronomically important members from the order Hemiptera include, but are not limited to: *Acrosternum hilare* Say (green stink bug); *Acyrthisiphon pisum* Harris (pea aphid); *Adelges* spp. (adelgids); *Adelphocoris rapidus* Say (rapid plant bug); *Anasa tristis* De Geer (squash bug); *Aphis craccivora* Koch (cowpea aphid); *A. fabae* Scopoli (black bean aphid); *A. gossypii* Glover (cotton aphid, melon aphid); *A. maidiradicis* Forbes (corn root aphid); *A. pomi* De Geer (apple aphid); *A. spiraecola* Patch (spirea aphid); *Aulacaspis tegalensis* Zehntner (sugarcane scale); *Aulacorthum solani* Kaltenbach (foxglove aphid); *Bemisia tabaci* Gennadius (tobacco whitefly, sweetpotato whitefly); *B. argentifolii* Bellows & Perring (silverleaf whitefly); *Blissus leucopterus leucopterus* Say (chinch bug); *Blostomatidae* spp.; *Brevicoryne brassicae* Linnaeus (cabbage aphid); *Cacopsylla pyricola* Foerster (pear *psylla*); *Calocoris norvegicus* Gmelin (potato capsid bug); *Chaetosiphon fragaefolii* Cockerell (strawberry aphid); *Cimicidae* spp.; *Coreidae* spp.; *Corythuca gossypii* Fabricius (cotton lace bug); *Cyrtopeltis modesta* Distant (tomato bug); *C. notatus* Distant (suckfly); *Deois flavopicta* Stal (spittlebug); *Dialeurodes citri* Ashmead (citrus whitefly); *Diaphnocoris chlorionis* Say (honeylocust plant bug); *Diuraphis noxia* Kurdjumov/Mordvilko (Russian wheat aphid); *Duplachionaspis divergens* Green (armored scale); *Dysaphis plantaginea* Paaserini (rosy apple aphid); *Dysdercus suturellus* Herrich-Schaffer (cotton stainer); *Dysmicoccus boninsis* Kuwana (gray sugarcane mealybug); *Empoasca fabae* Harris (potato leafhopper); *Eriosoma lanigerum* Hausmann (woolly apple aphid); *Erythroneoura* spp. (grape leafhoppers); *Eumetopina flavipes* Muir (Island sugarcane planthopper); *Eurygaster* spp.; *Euschistus servus* Say (brown stink bug); *E. variolarius* Palisot de Beauvois (one-spotted stink bug); *Graptostethus* spp. (complex of seed bugs); and *Hyalopterus pruni* Geoffroy (mealy plum aphid); *Icerya purchasi* Maskell (cottony cushion scale); *Labopidicola allii* Knight (onion plant bug); *Laodelphax striatellus* Fallen (smaller brown planthopper); *Leptoglossus corculus* Say (leaf-footed pine seed bug); *Leptodictya tabida* Herrich-Schaeffer (sugarcane lace bug); *Lipaphis erysimi* Kaltenbach (turnip aphid); *Lygocoris pabulinus* Linnaeus (common green capsid); *Lygus lineolaris* Palisot de Beauvois (tarnished plant bug); *L. Hesperus* Knight (Western tarnished plant bug); *L. pratensis* Linnaeus (common meadow bug); *L. rugulipennis* Poppius (European tarnished plant bug); *Macrosiphum euphorbiae* Thomas (potato aphid); *Macrosteles quadrilineatus* Forbes (aster leafhopper); *Magicicada septendecim* Linnaeus (periodical cicada); *Mahanarva fimbriolata* Stal (sugarcane spittlebug); *Melanaphis sacchari* Zehntner (sugarcane aphid); *Melanaspis glomerata* Green (black scale); *Metopolophium dirhodum* Walker (rose grain aphid); *Myzus persicae* Sulzer (peach-potato aphid, green peach aphid); *Nasonovia ribisnigri* Mosley (lettuce aphid); *Nephotettix cinticeps* Uhler (green leafhopper); *N. nigropictus* Stal (rice leafhopper); *Nezara viridula* Linnaeus (southern green stink bug); *Nilaparvata lugens* Stal (brown planthopper); *Nysius ericae* Schilling (false chinch bug); *Nysius raphanus* Howard (false chinch bug); *Oebalus pugnax* Fabricius (rice stink bug); *Oncopeltus fasciatus* Dallas (large milkweed bug); *Orthops campestris* Linnaeus; *Pemphigus* spp. (root aphids and gall aphids); *Peregrinus maidis* Ashmead (corn planthopper); *Perkinsiella saccharicida* Kirkaldy (sugarcane delphacid); *Phylloxera devastatrix* Pergande (pecan *phylloxera*); *Planococcus citri* Risso (citrus mealybug); *Plesiocoris rugicollis* Fallen (apple capsid); *Poecilocapsus lineatus* Fabricius (four-lined plant bug); *Pseudatomoscelis seriatus* Reuter (cotton fleahopper); *Pseudococcus* spp. (other mealybug complex); *Pulvinaria elongata* Newstead (cottony grass scale); *Pyrilla perpusilla* Walker (sugarcane leafhopper); *Pyrrhocoridae* spp.; *Quadraspidiotus perniciosus* Comstock (San Jose scale); *Reduviidae* spp.; *Rhopalosiphum maidis* Fitch (corn leaf aphid); *R. padi* Linnaeus (bird cherry-oat aphid); *Saccharicoccus sacchari* Cockerell (pink sugarcane mealybug); *Schizaphis graminum* Rondani (greenbug); *Sipha flava* Forbes (yellow sugarcane aphid); *Sitobion avenae* Fabricius (English grain aphid); *Sogatella*

*furcifera* Horvath (white-backed planthopper); *Sogatodes oryzicola* Muir (rice delphacid); *Spanagonicus albofasciatus* Reuter (whitemarked fleahopper); *Therioaphis maculata* Buckton (spotted alfalfa aphid); *Tinidae* spp.; *Toxoptera aurantii* Boyer de Fonscolombe (black citrus aphid); and *T. citricida* Kirkaldy (brown citrus aphid); *Trialeurodes abutiloneus* (bandedwinged whitefly) and *T. vaporariorum* Westwood (greenhouse whitefly); *Trioza diospyri* Ashmead (persimmon *psylla*); and *Typhlocyba pomaria* McAtee (white apple leafhopper).

Also included are adults and larvae of the order Acari (mites) such as *Aceria tosichella* Keifer (wheat curl mite); *Panonychus ulmi* Koch (European red mite); *Petrobia latens* Miller (brown wheat mite); *Steneotarsonemus bancrofti* Michael (sugarcane stalk mite); spider mites and red mites in the family Tetranychidae, *Oligonychus grypus* Baker & Pritchard, *O. indicus* Hirst (sugarcane leaf mite), *O. pratensis* Banks (Banks grass mite), *O. stickneyi* McGregor (sugarcane spider mite); *Tetranychus urticae* Koch (two spotted spider mite); *T. mcdanieli* McGregor (McDaniel mite); *T. cinnabarinus* Boisduval (carmine spider mite); *T. turkestani* Ugarov & Nikolski (strawberry spider mite), flat mites in the family Tenuipalpidae, *Brevipalpus lewisi* McGregor (citrus flat mite); rust and bud mites in the family Eriophyidae and other foliar feeding mites and mites important in human and animal health, i.e. dust mites in the family Epidermoptidae, follicle mites in the family Demodicidae, grain mites in the family Glycyphagidae, ticks in the order Ixodidae. *Ixodes scapularis* Say (deer tick); *I. holocyclus* Neumann (Australian paralysis tick); *Dermacentor variabilis* Say (American dog tick); *Amblyomma americanum* Linnaeus (lone star tick); and scab and itch mites in the families Psoroptidae, Pyemotidae, and Sarcoptidae.

Insect pests of the order Thysanura are of interest, such as *Lepisma saccharina* Linnaeus (silverfish); *Thermobia domestica* Packard (firebrat).

Additional arthropod pests covered include: spiders in the order Araneae such as *Loxosceles reclusa* Gertsch & Mulaik (brown recluse spider); and the *Latrodectus mactans* Fabricius (black widow spider); and centipedes in the order Scutigeromorpha such as *Scutigera coleoptrata* Linnaeus (house centipede). In addition, insect pests of the order Isoptera are of interest, including those of the termitidae family, such as, but not limited to, *Cylindrotermes nordenskioeldi* Holmgren and *Pseudacanthotermes militaris* Hagen (sugarcane termite). Insects of the order Thysanoptera are also of interest, including but not limited to *thrips*, such as *Stenchaetothrips minutus* van Deventer (sugarcane *thrips*).

Insect pests may be tested for pesticidal activity of compositions of the embodiments in early developmental stages, e.g., as larvae or other immature forms. The insects may be reared in total darkness at from about 20° C. to about 30° C. and from about 30% to about 70% relative humidity. Bioassays may be performed as described in Czapla and Lang (1990) *J. Econ. Entomol.* 83(6): 2480-2485. Methods of rearing insect larvae and performing bioassays are well known to one of ordinary skill in the art.

A wide variety of bioassay techniques are known to one skilled in the art. General procedures include addition of the experimental compound or organism to the diet source in an enclosed container. Pesticidal activity can be measured by, but is not limited to, changes in mortality, weight loss, attraction, repellency and other behavioral and physical changes after feeding and exposure for an appropriate length of time. Bioassays described herein can be used with any feeding insect pest in the larval or adult stage.

The following examples are presented by way of illustration, not by way of limitation.

EXPERIMENTALS

Example 1—Generation of Cry1B Variants with Improved Spectrum of Insecticidal Activity The Cry1Bd insecticidal protein having an amino acid of SEQ ID NO: 1 (U.S. Pat. No. 8,692,065) has high insecticidal activity (ILC50=1 ppm) against European corn borer (*Ostrinia nubilalis*) larvae but low insecticidal activity (ILC50>1000 ppm and ~400 ppm respectively) against corn earworm (*Helicoverpa zea*) and fall armyworm (*Spodoptera frugiperda*). The Cry1B insecticidal protein, referred to as MP258 (Serial No. PCT/US14/49923) having an amino acid of SEQ ID NO: 47 has high insecticidal activity (ILC50=4 ppm) against European corn borer (*Ostrinia nubilalis*) larvae but lower insecticidal activity (ILC50 24 ppm and 62 ppm respectively) against corn earworm (*Helicoverpa zea*) and fall armyworm (*Spodoptera frugiperda*). A series of variant Cry1B polypeptides derived from Cry1Bd (SEQ ID NO: 1) and MP258 were designed to improve the insecticidal activity against corn earworm (CEW) and/or fall armyworm (FAW) compared to Cry1Bd (SEQ ID NO: 1) and/or MP258 (SEQ ID NO: 47) while maintaining the ECB insecticidal activity. Variant Cry1B polypeptides having improved insecticidal activity that were generated include those indicated in Table 1. The insecticidal activity of the Cry1B variants was determined as described in Example 4 and the insecticidal activity results are shown in Table 3. An amino acid sequence alignment of the variant Cry1B polypeptides is shown in FIG. 1.

TABLE 1

| Clone ID | Polypeptide | Polynucleotide |
| --- | --- | --- |
| Cry1Bd | SEQ ID NO: 1 | SEQ ID NO: 2 |
| IP1B-B1 | SEQ ID NO: 3 | SEQ ID NO: 4 |
| IP1B-B21 | SEQ ID NO: 5 | SEQ ID NO: 6 |
| IP1B-B22 | SEQ ID NO: 7 | SEQ ID NO: 8 |
| IP1B-B23 | SEQ ID NO: 9 | SEQ ID NO: 10 |
| IP1B-B24 | SEQ ID NO: 11 | SEQ ID NO: 12 |
| IP1B-B25 | SEQ ID NO: 13 | SEQ ID NO: 14 |
| IP1B-B26 | SEQ ID NO: 15 | SEQ ID NO: 16 |
| IP1B-B27 | SEQ ID NO: 17 | SEQ ID NO: 18 |
| IP1B-B28 | SEQ ID NO: 19 | SEQ ID NO: 20 |
| IP1B-B29 | SEQ ID NO: 21 | SEQ ID NO: 22 |
| IP1B-B31 | SEQ ID NO: 23 | SEQ ID NO: 24 |
| IP1B-B32 | SEQ ID NO: 25 | SEQ ID NO: 26 |
| IP1B-B33 | SEQ ID NO: 27 | SEQ ID NO: 28 |
| IP1B-B34 | SEQ ID NO: 29 | SEQ ID NO: 30 |
| IP1B-B40 | SEQ ID NO: 31 | SEQ ID NO: 32 |
| IP1B-B41 | SEQ ID NO: 33 | SEQ ID NO: 34 |
| IP1B-B42 | SEQ ID NO: 35 | SEQ ID NO: 36 |
| IP1B-B43 | SEQ ID NO: 37 | SEQ ID NO: 38 |
| IP1B-B44 | SEQ ID NO: 39 | SEQ ID NO: 40 |
| IP1B-B45 | SEQ ID NO: 41 | SEQ ID NO: 42 |
| IP1B-B46 | SEQ ID NO: 43 | SEQ ID NO: 44 |
| IP1B-B47 | SEQ ID NO: 45 | SEQ ID NO: 46 |
| MP258 | SEQ ID NO: 47 | SEQ ID NO: 48 |
| GS060 | SEQ ID NO: 49 | SEQ ID NO: 50 |

The percent amino acid sequence identity of the Cry1B variant polypeptides calculated using the Needleman-Wunsch algorithm, as implemented in the Needle program (EMBOSS tool suite), are shown as a matrix table in Table 2. The void part of the matrix table is not shown.

TABLE 2

| | GS060 | IP1B-B1 | IP1B-B21 | IP1B-B22 | IP1B-B23 | IP1B-B24 | IP1B-B25 | IP1B-B26 | IP1B-B27 | IP1B-B28 | IP1B-B29 |
|---|---|---|---|---|---|---|---|---|---|---|---|
| Cry1Bd | 65.6 | 95.4 | 84.3 | 82.6 | 82.5 | 84.3 | 84.3 | 84.2 | 83.7 | 83.7 | 83.7 |
| GS060 | — | 67.0 | 60.1 | 60.2 | 60.1 | 60.1 | 60.2 | 60.1 | 60.0 | 59.9 | 60.1 |
| IP1B-B1 | — | — | 83.4 | 82.6 | 84.5 | 83.4 | 83.4 | 83.2 | 82.9 | 82.9 | 82.9 |
| IP1B-B21 | — | — | — | 95.4 | 96.9 | 99.7 | 99.7 | 99.5 | 99.1 | 99.1 | 99.1 |
| IP1B-B22 | — | — | — | — | 95.4 | 95.1 | 95.1 | 95.0 | 94.5 | 94.8 | 94.8 |
| IP1B-B23 | — | — | — | — | — | 96.6 | 96.6 | 96.5 | 96.0 | 96.0 | 96.0 |
| IP1B-B24 | — | — | — | — | — | — | 99.4 | 99.2 | 98.8 | 98.8 | 98.8 |
| IP1B-B25 | — | — | — | — | — | — | — | 99.8 | 99.4 | 99.4 | 99.4 |
| IP1B-B26 | — | — | — | — | — | — | — | — | 99.5 | 99.2 | 99.2 |
| IP1B-B27 | — | — | — | — | — | — | — | — | — | 99.4 | 99.4 |
| IP1B-B28 | — | — | — | — | — | — | — | — | — | — | 99.8 |

| | IP1B-B31 | IP1B-B32 | IP1B-B33 | IP1B-B34 | IP1B-B40 | IP1B-B41 | IP1B-B42 | IP1B-B43 | IP1B-B44 | IP1B-B45 | IP1B-B46 | IP1B-B47 | MP258 |
|---|---|---|---|---|---|---|---|---|---|---|---|---|---|
| Cry1Bd | 80.4 | 80.4 | 81.0 | 82.0 | 83.7 | 83.9 | 83.9 | 83.9 | 83.9 | 83.9 | 83.9 | 83.9 | 82.3 |
| GS060 | 66.6 | 66.9 | 66.3 | 65.5 | 59.8 | 59.9 | 60.1 | 60.1 | 60.1 | 60.1 | 59.9 | 59.9 | 59.9 |
| IP1B-B1 | 83.6 | 83.0 | 82.7 | 81.6 | 82.8 | 82.9 | 83.1 | 83.1 | 83.1 | 83.1 | 83.1 | 83.1 | 80.9 |
| IP1B-B21 | 71.6 | 71.5 | 71.8 | 71.8 | 99.1 | 99.1 | 99.2 | 99.2 | 99.2 | 99.2 | 99.2 | 99.2 | 96.9 |
| IP1B-B22 | 70.7 | 70.4 | 70.7 | 71.0 | 94.7 | 94.7 | 94.7 | 94.7 | 94.7 | 94.7 | 94.8 | 94.8 | 97.6 |
| IP1B-B23 | 72.5 | 72.3 | 72.6 | 72.3 | 96.0 | 96.0 | 96.2 | 96.2 | 96.2 | 96.2 | 96.2 | 96.2 | 96.0 |
| IP1B-B24 | 71.6 | 71.5 | 71.8 | 71.8 | 98.8 | 98.9 | 98.9 | 98.9 | 98.9 | 98.9 | 98.9 | 98.9 | 96.6 |
| IP1B-B25 | 71.8 | 71.6 | 71.9 | 71.9 | 99.4 | 99.4 | 99.5 | 99.5 | 99.5 | 99.5 | 99.5 | 99.5 | 96.6 |
| IP1B-B26 | 71.6 | 71.5 | 71.8 | 71.8 | 99.5 | 99.2 | 99.4 | 99.4 | 99.4 | 99.4 | 99.4 | 99.4 | 96.5 |
| IP1B-B27 | 71.3 | 71.2 | 71.5 | 71.3 | 99.2 | 98.9 | 99.7 | 99.5 | 99.5 | 99.5 | 99.2 | 99.2 | 96.0 |
| IP1B-B28 | 71.3 | 71.2 | 71.5 | 71.3 | 99.1 | 99.1 | 99.4 | 99.2 | 99.2 | 99.2 | 99.5 | 99.5 | 96.3 |
| IP1B-B29 | 71.3 | 71.2 | 71.5 | 71.3 | 99.1 | 99.1 | 99.4 | 99.2 | 99.2 | 99.2 | 99.4 | 99.4 | 96.3 |
| IP1B-B31 | — | 99.4 | 99.1 | 98.0 | 71.3 | 71.6 | 71.5 | 71.5 | 71.5 | 71.5 | 71.5 | 71.5 | 69.2 |
| IP1B-B32 | — | — | 99.2 | 98.0 | 71.2 | 71.5 | 71.3 | 71.3 | 71.3 | 71.3 | 71.3 | 71.3 | 69.1 |
| IP1B-B33 | — | — | — | 98.0 | 71.5 | 71.8 | 71.6 | 71.6 | 71.6 | 71.6 | 71.6 | 71.6 | 69.4 |
| IP1B-B34 | — | — | — | — | 71.5 | 71.8 | 71.5 | 71.5 | 71.5 | 71.5 | 71.5 | 71.5 | 69.7 |
| IP1B-B40 | — | — | — | — | — | 99.7 | 99.1 | 99.1 | 99.1 | 99.2 | 99.2 | 99.4 | 96.2 |
| IP1B-B41 | — | — | — | — | — | — | 99.1 | 99.1 | 99.1 | 99.2 | 99.2 | 99.4 | 96.2 |
| IP1B-B42 | — | — | — | — | — | — | — | 99.8 | 99.8 | 99.7 | 99.5 | 99.4 | 96.2 |
| IP1B-B43 | — | — | — | — | — | — | — | — | 99.8 | 99.8 | 99.5 | 99.4 | 96.2 |
| IP1B-B44 | — | — | — | — | — | — | — | — | — | 99.7 | 99.7 | 99.7 | 96.2 |
| IP1B-B45 | — | — | — | — | — | — | — | — | — | — | 99.4 | 99.7 | 96.2 |
| IP1B-B46 | — | — | — | — | — | — | — | — | — | — | — | 99.7 | 96.3 |
| IP1B-B47 | — | — | — | — | — | — | — | — | — | — | — | — | 96.3 |

Example 2—Saturation Mutagenesis at Selected Positions of MP258 and IP1B Variant Cry1B Polypeptides The polynucleotides of SEQ ID NO: 48, SEQ ID NO: 6, SEQ ID NO: 14, and SEQ ID NO: 42 encoding MP258, IP1B-B21, IP1B-B25 and IP1B-B45 (SEQ ID NO: 47, SEQ ID NO: 5, SEQ ID NO: 13, and SEQ ID NO: 41 respectively) were used as the templates for saturation mutagenesis at selected amino acid positions. A reverse mutagenesis primer and a complementary forward mutagenesis primer were designed to create the desired amino acid substitution(s) at the site(s) of interest. Typically the mutagenesis primer was between 30 to 45 bases in length with two or more bases, usually 10 to 15, on both sides of the site of interest. In order to make saturation mutagenesis, degenerated primers that cover all possible amino acid residues were used. The mutagenic reactions were carried out using Agilent's QuikChange™ Lightening Site-Directed Mutagenesis kit. Materials provided in the kit are QuikChange™ Lightening Enzyme, 10X QuikChange™ Lightning Buffer, dNTP mix, QuikSolution™ reagent and DpnI restriction enzyme according to the manufactures directions.

PCR amplifications were typically carried out with Expand™ High Fidelity PCR system (Roche, Switzerland) in 50 ul containing 50-100 ng templates, 0.4-2 µM primer pair, 200 µM dNTPs and 2 Units of DNA polymerase. The mutagenesis reaction was initiated by pre-heating the reaction mixture to 94° C. for 3 min, followed by 16 cycles of the following cycling program: 94° C. for 1 min, 52° C. for 1 min and 68° C. for 8, 12, 16 or 24 min according to the length of template. The mutagenesis reaction was completed by incubation at 68° C. for 1 h. The PCR-amplification products were evaluated by agarose gel electrophoresis. The PCR products were purified by QIAquick™ PCR purification kit (Qiagen, Germany) and further treated with the restriction enzyme DpnI. An aliquot of 1 pl of the PCR product was typically transformed into BL21(DE3) cells and inoculated on Luria-Bertani (LB) plate containing 100 µg/ml ampicillin. About 48 or more colonies for saturation mutagenesis were selected and plasmid DNA was isolated for sequencing. Two step sequencing was used, first for specific mutation site(s) with one sequencing primer followed by full length sequence confirmation with multiple sequencing primers. After all 19 amino acid mutations were confirmed by sequencing, those mutant genes were advanced for expression and protein purification.

In the case of mutations made to cover the entire IP1B-B25 Domain III spanning from T495 to E655, 48 mutant clones were picked from each site and screened for the CEW activity, as described in Example 4. In order to sequence those mutant clones to determine mutated amino acids, among 151 amino acid residues subjected to mutagenesis, 103 sites were sequenced based on the number of up-mutations and down-mutations. Those sites containing mutants showing no significant activity changes were not sequenced.

Example 3—Purification of Variant Cry1B Insecticidal Proteins

Variant Cry1B insecticidal protein genes were expressed in a modified pMAL vector (Cat # E8000S from New England Biolabs) as a fusion with MBP (maltose binding protein). The pMAL vector was modified to attach a 6×His tag to the N-terminal end of MBP after methionine at position 1. The plasmid containing the insecticidal protein gene was cloned in *E. coli* BL21 (DE3). The BL21 cells were grown in MagicMedia™ (Life Technologies) in either 96 deep well plates or flasks in a shaker running at 250 rpm at 37° C. for 8 hrs followed by 16° C. for 64 hrs. During the 16° C. incubation, the MBP-toxin fusion protein was accumulated in the BL21 cell as a soluble protein.

In order to purify the fusion protein, the *E. coli* cells were harvested by centrifugation and treated in a lysozyme solution consisting of 2 mg/ml lysozyme in 50 ml sodium phosphate buffer at pH8 containing 300 mM NaCl, 2U/ml endonuclease (Epicentre) and 5 mM MaCl2 for 3 hrs at 37° C. with gentle shaking. The lysozyme treated *E. coli* cells were then disrupted with 1% Triton X100 and clear lysate containing the IP-1B proteins were prepared by centrifugation at 4000 rpm, 30 min (96 well plates) or 9000 rpm (flask produced samples). His tagged MBP-toxin proteins were purified from the clear lysate by affinity chromatography using NiNTA agarose from Qiagen™ following the manufacturer's standard procedure. For those clear lysate samples made in 96 well plates, Pall Corporation™ (25 Harbor Park Drive Port Washington, N.Y. 11050) 96 deep well filter plates were used as affinity chromatography columns. The purified toxin proteins eluted from NiNTA agarose was passed through Sephadex G25 to change the phosphate buffer to 25 mM HEPES-NaOH, pH8 and used in insect bioassay for determining the insecticidal. MBP was digested with 1/100 (w/w) Factor Xa (New England Biolabs) at 25° C. for overnight and removed from the IP-1B proteins by Superdex 200 column chromatography utilizing the size difference and a weak affinity of MBP to Superdex.

Protein concentrations were determined by capillary electrophoresis with the LabChip™ GXII device (Caliper LifeSciences). The protein analysis was repeated at least 3 times until the final concentrations were considered to be reliable within the predetermined deviation, less than 10%.

Example 4—Determination of the Insecticidal Activity of Variant IP-1B Proteins

The activity of Cry1B polypeptide variants against major corn pests, European Corn Borer (ECB, *Ostrinia nubilalis*), Corn Earworm (CEW *Helicoverpa zea*) and Fall Armyworm (FAW, *Spodoptera frugiperda*), was determined by feeding assay as described by Cong, R., et al. Proceedings of the 4th Pacific Rim Conferences on Biotechnology of *Bacillus thuringiensis* and its environmental impact, pp. 118-123, ed. by R. J. Akhurst, C. E. Beard and P. Hughes, published in 2002, Canberra, Australia. Briefly, the assays were conducted on an artificial diet containing the insecticidal proteins. The insecticidal proteins were prepared as described in Example 1, and 10 µL of protein samples were mixed with 40 µL of molten (40-50° C.) artificial insect diet prepared based on Southland Premix formulated for Lepidopteran insects (Southland Products, Lake Village, AR) with low temperature melting agarose. The diet-insecticidal protein mixture was placed in each well of a 96 well micro-titer plate. One or more neonate insect larvae were placed in each well to feed for 4 days for CEW and FAW and 5 days for ECB at 28° C.

Alternatively, insect eggs or larvae were sorted by Large Particle Flow Cytometry using COPAS™ (Complex Object Parametric Analyzer and Sorter) obtained from Union Biometrica (Holliston, Mass.) to place one egg or larva per well in a 96-well micro-titer plate that contains solidified artificial insect diet. When eggs were used to place in the assay plates, only those wells containing hatched larvae after 16 hours were used for assay data collection. Usually 90 to 95% hatch rates were obtained due to efficient COPAS sorting. After certain feeding periods, the response of insects towards the proteins was scored using a 0-3 numerical scoring system based on the size and mortality of the larvae in each well. If no response (or normal growth) was seen, a score of 0 was given. When the growth was slightly retarded, a score of 1 was given. A score of 2 meant that the larvae were severely retarded in growth (close to neonate size). A score of 3 meant death to all the larvae in the well. The percent response (Response) for each treatment was calculated by dividing the total score, a sum of scores from replicating wells for each treatment by the total highest possible scores. For example, if one treatment (one sample, one dose) had 6 replicating wells, the total highest possible score would be 3×6=18.

In order to identify variant Cry1B polypeptides that have increased levels of the activity toward those corn pests, significantly higher than the activity reference such as the wild type, non-mutated reference protein (e.g. MP258 SEQ ID NO: 47). Variant polypeptides at certain concentrations were assayed along with 4 doses of the reference protein within one 96-well assay plate. The concentrations of the insecticidal proteins were within the 4 doses of the reference protein concentrations, preferably around the middle point of the 4 dose concentrations. Each sample plate contained the reference protein in a significant number of wells such as 16 wells in 4 separate doses. Also in each plate, up to 80 mutants proteins for activity comparison with the reference protein were included. From a sample plate, 10 ul of samples from each well were picked by multi-channel pipette and dispensed in one assay plate containing 40ul molten diet in each well and mixed on a shaker. This process of producing the assay plate was repeated as many as 6 times or more to produce a desired number of assay plates. After the diet was solidified and cooled to 4C, neonate insect larvae were placed in each well, sealed with perforated Mylar film and incubated in a constant temperature incubator at 28° C. After certain feeding period, the insect responses were scored under a magnifying glass. The sigmoid dose-response values (Responses) were converted to liner probit dose-response values using SAS-JMP®, Generalized Linear Model, Binomial Response, Probit). The response for each protein in replicates was summed and compared with the probit dose—response line of the activity reference protein, creating a new number called the FAE guide number (Fast Activity Evaluation). For example, if a mutant protein showed a certain probit value at 40 ppm and the actual dose with the same probit value for the reference protein was 100 ppm; then the FAE value is 2.5 (100/40). This means the mutant protein is 2.5 times more potent than the reference protein. This assay was done with 2 different doses of mutant proteins at a time and repeated 3 times generating 6 FAE guide number data points for each mutant. The mean FAE guide number was called the FAE Index. For each protein, a two sided t-test was done comparing the 6 FAE guide numbers. The Bonferroni correction was used to evaluate p-values (number of novel proteins/alpha) to determine if the FAE Index was statistically significant.

The other screening method used in this patent application is High Dose Assay (HDA). In this method, test proteins at high concentrations (above EC50) were placed on the insect assay plates as described above, along with a similar concentration of one or more reference proteins with a known activity level. This HDA was often used in a tiered screening to eliminate low or no activity proteins quickly.

Yet another screening method used was High throughput Functional Assay (HFA). This assay was similar to FAE but used only one dose instead of 2 doses. Otherwise HFA, especially the way it calculates the index was identical to FAE. Therefor the HFA index has the same significance as the FAE index.

The predicted point with 50% response in the scoring scheme called ILC50 as it is a combination of growth or feeding Inhibition and Lethal responses. In order to determine ILC50 values, each treatment (one dose) was repeated 6 or more, usually 24, times. The insecticidal activity of the Cry1B variants is shown in Table 3.

Table 4 shows the insecticidal activity against corn earworm for the amino acid substitutions having increased activity (FAE score >1.2) compared to the reference polypeptide MP258 (SEQ ID NO: 47), IP1B-B21 (SEQ ID NO: 5), IP1B-B25 (SEQ ID NO: 13), or IP1B-B45 (SEQ ID NO: 41). Table 4 indicates the position number and amino acid corresponding to positions 50-651 of MP258 (SEQ ID NO: 47); the predicted secondary structure and assignment; solvent exposure score; an alignment of the amino acid sequence of MP258 (SEQ ID NO: 47); IP1B-B21 (SEQ ID NO: 5), IP1B-B25 (SEQ ID NO: 13), IP1B-B45 (SEQ ID NO: 41), IP1B-B21 (SEQ ID NO: 5), Cry1Bd (SEQ ID NO: 1), Cry1Bh (SEQ ID NO: 52), and Cry1Bi (SEQ ID NO: 54); the polypeptide backbone the variant was made in; the amino acid substitution variant (e.g. L50R); and the FAE insecticidal score against corn earworm compared to the corresponding polypeptide backbone (MP258—SEQ ID NO: 47, IP1B-B21—SEQ ID NO: 5, IP1B-B25—SEQ ID NO: 13, or IP1B-B45—SEQ ID NO: 41).

TABLE 3

| Clone ID | Polypeptide SEQ ID NO | ECB | CEW | FAW |
|---|---|---|---|---|
| Cry1Bd | SEQ ID NO: 1 | ILC50 = 1 ppm | ILC50 = >1000 ppm | ILC50 = ~400 ppm |
| IP1B-B1 | SEQ ID NO: 3 | ILC50 = 1.3 ppm | ILC50 = 21 ppm | ILC50 = 34.3 ppm |
| IP1B-B21 | SEQ ID NO: 5 | | ILC50 = 22.4 ppm | |
| IP1B-B22 | SEQ ID NO: 7 | | ILC50 = 27.1 ppm | |
| IP1B-B23 | SEQ ID NO: 9 | | ILC50 = 29.2 ppm | |
| IP1B-B24 | SEQ ID NO: 11 | | ILC50 = 12.6 ppm | |
| IP1B-B25 | SEQ ID NO: 13 | | ILC50 = 11.91 ppm | |
| IP1B-B26 | SEQ ID NO: 15 | | ILC50 = 8.36 ppm | |
| IP1B-B27 | SEQ ID NO: 17 | | ILC50 = 7.99 ppm | |
| IP1B-B28 | SEQ ID NO: 19 | | ILC50 = 7.74 ppm | |
| IP1B-B29 | SEQ ID NO: 21 | | ILC50 = 8.45 ppm | |
| IP1B-B31 | SEQ ID NO: 23 | | | ILC50 = 2.8 ppm |
| IP1B-B32 | SEQ ID NO: 25 | | | ILC50 = 2.9 ppm |
| IP1B-B33 | SEQ ID NO: 27 | | | ILC50 = 3.0 ppm |
| IP1B-B34 | SEQ ID NO: 29 | | | ILC50 = 2.9 ppm |
| IP1B-B40 | SEQ ID NO: 31 | | ILC50 = 5.78 ppm | |
| IP1B-B41 | SEQ ID NO: 33 | | ILC50 = 4.54 ppm | |
| IP1B-B42 | SEQ ID NO: 35 | | ILC50 = 6.2 ppm | |
| IP1B-B43 | SEQ ID NO: 37 | | ILC50 = 6.7 ppm | |
| IP1B-B44 | SEQ ID NO: 39 | | ILC50 = 6.9 ppm | |
| IP1B-B45 | SEQ ID NO: 41 | | ILC50 = 5.7 ppm | |
| IP1B-B46 | SEQ ID NO: 43 | | ILC50 = 8 ppm | |
| IP1B-B47 | SEQ ID NO: 45 | | ILC50 = 6.1 ppm | |
| MP258 | SEQ ID NO: 47 | ILC50 = 4 ppm | ILC50 = 24 ppm | ILC50 = 62 ppm |

Table 5 shows the insecticidal activity against corn earworm for the amino acid substitutions having a FAE score <1.2 compared to the polypeptide backbone MP258 (SEQ ID NO: 47), IP1B-B21 (SEQ ID NO: 5), IP1B-B25 (SEQ ID NO: 13), or IP1B-B45 (SEQ ID NO: 41). Table 5 indicates the position number and amino acid corresponding to positions 50-651 of MP258 (SEQ ID NO: 47); the polypeptide backbone the variant was made in; the amino acid substitution variant (e.g. L50R); and the FAE insecticidal score against corn earworm compared to the corresponding polypeptide backbone (MP258—SEQ ID NO: 47, IP1B-B21—SEQ ID NO: 5, IP1B-B25—SEQ ID NO: 13, or IP1B-B45—SEQ ID NO: 41.

TABLE 4

| MP258 position | a.a. | 2D Struc | 2D Assign | Sol. Exp. | MP258 | B21 | B25 | B45 | Bd | Bh | Bi | backbone | Variant | FAE | Variant | FAE | Variant | FAE | Variant | FAE | Variant | FAE |
|---|---|---|---|---|---|---|---|---|---|---|---|---|---|---|---|---|---|---|---|---|---|---|
| 50 | L | Coil | | 90 | L | L | L | L | L | L | L | | L50R L50Y L50N | 1.72 1.42 1.26 | L50I L50S | 1.52 1.38 | L50D L50F | 1.5 1.38 | L50A L50V | 1.43 1.37 | L50H L50K | 1.42 1.34 |
| 51 | V | Helix | a1 | 37 | V | V | V | V | V | V | V | | | | | | | | | | | |
| 52 | S | Helix | | 20 | S | S | S | S | S | S | S | | | | | | | | | | | |
| 53 | A | Helix | | 67 | A | A | A | A | A | A | A | B45 | A53R A53V A53T | 1.79 1.35 1.21 | A53Y A53Q | 1.72 1.31 | A53K A53D | 1.7 1.25 | A53H A53E | 1.45 1.23 | A53P A53G | 1.42 1.22 |
| 54 | S | Helix | | 47 | S | S | S | S | S | S | S | B45 | S54P S54R | 1.6 1.21 | S54K | 1.4 | S54G | 1.39 | S54A | 1.36 | S54I | 1.25 |
| 55 | T | Helix | | 0 | T | T | T | T | T | T | T | | | | | | | | | | | |
| 56 | V | Helix | | 5 | V | V | V | V | V | V | V | | | | | | | | | | | |
| 57 | Q | Helix | | 75 | Q | Q | Q | Q | Q | Q | Q | B45 | Q57V Q57D | 1.76 1.3 | Q57R | 1.71 | Q57L | 1.54 | Q57N | 1.53 | Q57G | 1.38 |
| 58 | T | Helix | | 33 | T | T | T | T | T | T | T | | | | | | | | | | | |
| 59 | G | Helix | | 4 | G | G | G | G | G | G | G | | | | | | | | | | | |
| 60 | I | Helix | | 3 | I | I | I | I | I | I | I | | | | | | | | | | | |
| 61 | N | Helix | | 27 | N | N | N | N | N | N | N | | | | | | | | | | | |
| 62 | I | Helix | | 3 | I | I | I | I | I | I | I | | | | | | | | | | | |
| 63 | A | Helix | | 19 | A | A | A | A | A | A | A | | | | | | | | | | | |
| 64 | G | Helix | | 4 | G | G | G | G | G | G | G | | | | | | | | | | | |
| 65 | R | Helix | | 42 | R | R | R | R | R | R | R | B45 | R65Q | 1.54 | R65A | 1.53 | R65S | 1.48 | R65G | 1.36 | | |
| 66 | I | Helix | | 4 | I | I | I | I | I | I | I | | | | | | | | | | | |
| 67 | L | Helix | | 27 | L | L | L | L | L | L | L | B45 | L67M | 2.03 | L67F | 1.41 | L67I | 1.27 | | | | |
| 68 | G | Helix | | 113 | G | G | G | G | G | G | G | B45 | G68A | 1.83 | G68R | 1.3 | G68F | 1.27 | | | | |
| 69 | V | Helix | | 6 | V | V | V | V | V | V | V | | | | | | | | | | | |
| 70 | L | Turn | | 1 | L | L | L | L | L | L | L | B45 | L70E | 1.51 | L70W | 1.3 | L70H | 1.23 | | | | |
| 71 | G | Coil | | 8 | G | G | G | G | G | G | G | B45 | G71S | 1.33 | | | | | | | | |
| 72 | V | Coil | | 22 | V | V | V | V | V | V | V | B45 | V72G | 1.87 | | | | | | | | |
| 73 | P | Coil | | 46 | P | P | P | P | P | P | P | B45 | P73S | 1.27 | P73G | 1.35 | | | | | | |
| 74 | F | Coil | | 94 | F | F | F | F | F | F | F | B45 | F74I F74D | 1.92 1.24 | F74E | 1.91 | F74S | 1.64 | F74R | 1.33 | F74V | 1.25 |
| 75 | A | Helix | a2 | 33 | A | A | A | A | A | A | A | B45 | A75S | 2.23 | A75P | 1.67 | A75E | 1.28 | | | | |
| 76 | G | Helix | | 115 | G | G | G | G | G | G | G | B45 | G76T G76R | 2.01 1.4 | G76S | 1.76 | G76Y | 1.6 | G76V | 1.6 | G76D | 1.41 |
| 77 | Q | Helix | | 53 | Q | Q | Q | Q | Q | Q | Q | B45 | Q77N Q77H Q77C | 1.86 1.64 1.38 | Q77D Q77P Q77S | 1.82 1.63 1.22 | Q77G Q77A | 1.78 1.59 | Q77L Q77T | 1.76 1.58 | Q77I Q77M | 1.69 1.39 |
| 78 | L | Helix | | 8 | L | L | L | L | L | L | L | | | | | | | | | | | |
| 79 | A | Helix | | 36 | A | A | A | A | A | A | A | B45 | A79S A79I | 1.83 1.55 | A79V A79P | 1.78 1.5 | A79T A79N | 1.71 1.32 | A79L A79Q | 1.69 1.31 | A79R A79K | 1.65 1.23 |
| 80 | S | Helix | | 61 | S | S | S | S | S | S | S | B45 | S80Q S80M S80D | 2.06 1.77 1.29 | S80K S80N | 1.97 1.66 | S80G S80C | 1.93 1.56 | S80E S80W | 1.86 1.45 | S80R S80Y | 1.84 1.44 |
| 81 | F | Helix | | 4 | F | F | F | F | F | F | F | | | | | | | | | | | |
| 82 | Y | Helix | | 4 | Y | Y | Y | Y | Y | Y | Y | B45 | Y82F | 1.41 | | | | | | | | |
| 83 | S | Helix | | 85 | S | S | S | S | S | S | S | B45 | S83E S83H | 1.97 1.7 | S83D S83R | 1.91 1.51 | S83G S83Y | 1.89 1.39 | S83A S83L | 1.87 1.32 | S83K | 1.8 |
| 84 | F | Helix | | 54 | F | F | F | F | F | F | F | | | | | | | | | | | |

TABLE 4-continued

| MP258 position | a.a. | 2D Struc | 2D Assign | Sol. Exp. | MP258 | B21 | B25 | B45 | Bd | Bh | Bi | backbone | Variant | FAE | Variant | FAE | Variant | FAE | Variant | FAE |
|---|---|---|---|---|---|---|---|---|---|---|---|---|---|---|---|---|---|---|---|---|
| 85 | I | Helix | | 5 | I | I | I | I | L | L | I | | | | | | | | | |
| 86 | V | Helix | | 22 | V | V | V | V | V | V | V | | | | | | | | | |
| 87 | G | Helix | | 101 | G | G | G | G | G | G | G | B45 | G87D | 1.95 | G87K | 1.65 | G87N | 1.44 | G87C | 1.42 | G87W | 1.28 |
| | | | | | | | | | | | | | G87H | 1.24 | | | | | | | | |
| 88 | E | Helix | | 19 | E | E | E | E | E | E | E | | | | | | | | | |
| 89 | L | Helix | | 2 | L | L | L | L | L | L | L | | | | | | | | | |
| 90 | W | Coil | | 11 | W | W | W | W | W | W | W | | | | | | | | | |
| 91 | P | Coil | | 44 | P | P | P | P | P | P | P | B45 | P91S | 1.64 | P91Y | 1.49 | P91T | 1.46 | P91D | 1.28 |
| 92 | S | Coil | | 93 | S | S | S | S | S | S | G | B45 | S92E | 2.54 | S92G | 1.88 | S92F | 1.72 | S92L | 1.71 |
| | | | | | | | | | | | | | S92T | 1.47 | | | | | | | |
| 93 | G | Coil | | 140 | G | G | G | G | G | G | G | B45 | G93D | 1.68 | G93H | 1.53 | | | G93I | 1.28 | | |
| 94 | R | Coil | a2 | 97 | R | R | R | R | R | R | R | B45 | R94L | 2.27 | R94H | 2.19 | R94T | 1.7 | R94S | 1.35 |
| 95 | D | Coil | | 35 | D | D | D | D | D | D | D | B45 | D95G | 1.86 | D95Q | 1.67 | D95V | 1.55 | D95F | 1.2 |
| 96 | P | Helix | | 18 | P | P | P | P | P | P | Q | | | | | | | | | |
| 97 | W | Helix | | 2 | W | W | W | W | W | W | W | | | | | | | | | |
| 98 | E | Helix | | 35 | E | E | E | E | E | E | E | | | | | | | | | |
| 99 | I | Helix | | 29 | I | I | I | I | I | I | F | | | | | | | | | |
| 100 | F | Helix | | 1 | F | F | F | F | F | F | M | | | | | | | | | |
| 101 | L | Helix | | 4 | L | L | L | L | L | L | E | | | | | | | | | |
| 102 | E | Helix | | 40 | E | E | E | E | E | E | H | | | | | | | | | |
| 103 | H | Helix | | 0 | H | H | H | H | H | H | V | | | | | | | | | |
| 104 | V | Helix | | 0 | V | V | V | V | V | V | E | | | | | | | | | |
| 105 | E | Helix | | 16 | E | E | E | E | E | E | Q | | | | | | | | | |
| 106 | Q | Helix | | 75 | Q | Q | Q | Q | Q | Q | Q | B45 | Q106I | 2.16 | Q106A | 1.77 | Q106F | 1.74 | Q106G | 1.71 | Q106R | 1.29 |
| | | | | | | | | | | | | | Q106H | 1.67 | Q106C | 1.52 | Q106K | 1.43 | Q106V | 1.32 | | |
| | | | | | | | | | | | | | Q106S | 1.25 | | | | | | | | |
| 107 | L | Helix | | 0 | L | L | L | L | L | L | L | | | | | | | | | |
| 108 | V | Helix | | 5 | V | V | V | V | V | V | I | B45 | V108L | 1.92 | V108M | 1.55 | V108T | 1.29 | | | | |
| 109 | R | Turn | | 94 | R | R | R | R | R | R | R | 258 | R109S | 1.35 | R109V | 1.28 | R109N | 1.23 | | | | |
| 110 | Q | Coil | | 54 | Q | Q | Q | Q | Q | Q | Q | 258 | Q110T | 1.93 | Q110R | 1.51 | Q110V | 1.32 | Q110H | 1.24 |
| 111 | Q | Coil | | 87 | Q | Q | Q | H | Q | Q | Q | 258 | Q111H | 4.5 | Q111K | 2.97 | Q111S | 2.37 | Q111R | 2.14 |
| | | | | | | | | | | | | | Q111A | 1.99 | Q111L | 1.8 | Q111E | 1.54 | | | | |
| 112 | I | Coil | | 0 | I | I | I | I | I | I | I | B45 | I112L | 2.03 | | | | | | | |
| 113 | T | Coil | | 80 | T | T | T | T | T | T | T | B45 | T113L | 1.44 | T113V | 1.4 | T113S | 1.34 | T113N | 1.29 | T113K | 1.25 |
| 114 | E | Helix | a3 | 73 | E | E | E | M | E | E | A | 258 | E114L | 2.67 | E114T | 2.29 | E114M | 2.11 | E114H | 2.03 | E114Y | 1.94 |
| | | | | | | | | | | | | | E114A | 1.73 | E114S | 1.67 | E114V | 1.54 | E114F | 1.39 | | |
| 115 | N | Helix | | 116 | N | N | N | N | N | N | N | | N115P | 1.39 | | | | | | | | |
| 116 | A | Helix | | 11 | A | A | A | A | A | A | A | | | | | | | | | |
| 117 | R | Helix | | 18 | R | R | R | R | R | R | R | | | | | | | | | |
| 118 | N | Helix | | 79 | N | N | N | N | N | N | N | B45 | N118V | 2.16 | N118T | 1.84 | N118E | 1.72 | N118D | 1.4 | N118F | 1.37 |
| | | | | | | | | | | | | | N118G | 1.22 | | | | | | | | |
| 119 | T | Helix | | 55 | T | T | T | T | T | T | T | B45 | T119E | 2.3 | T119M | 2.08 | T119A | 1.89 | T119K | 1.76 | T119H | 1.69 |
| | | | | | | | | | | | | | T119R | 1.66 | T119R | 1.65 | T119V | 1.44 | | | | |
| 120 | A | Helix | | 5 | A | A | A | A | A | A | A | | | | | | | | | |
| 121 | L | Helix | | 20 | L | L | L | L | L | L | L | | | | | | | | | |
| 122 | A | Helix | | 87 | A | A | A | A | A | A | A | B45 | A122R | 1.38 | A122I | 1.32 | A122F | 1.27 | A122N | 1.26 | A122G | 1.23 |
| | | | | | | | | | | | | | A122T | 1.23 | | | | | | | | |
| 123 | R | Helix | | 55 | R | R | R | R | R | R | R | B45 | R123K | 1.81 | | | | | | | | |
| 124 | L | Helix | | 6 | L | L | L | L | L | L | L | | | | | | | | | |
| 125 | Q | Helix | | 58 | Q | Q | Q | Q | E | E | Q | B45 | Q125N | 1.83 | Q125R | 1.58 | Q125E | 1.48 | | | | |
| 126 | G | Helix | | 103 | G | G | G | G | G | G | G | | | | | | | | | |

TABLE 4-continued

| MP258 position | a.a. | 2D Struc | 2D Assign | Sol. Exp. | MP258 | B21 | B25 | B45 | Bd | Bh | Bi | backbone | Variant | FAE | Variant | FAE | Variant | FAE | Variant | FAE | Variant | FAE |
|---|---|---|---|---|---|---|---|---|---|---|---|---|---|---|---|---|---|---|---|---|---|---|
| 127 | L | Helix | | 9 | L | L | L | L | L | L | L | | | | | | | | | | | |
| 128 | G | Helix | | 0 | G | G | G | G | G | G | G | | | | | | | | | | | |
| 129 | A | Helix | | 96 | A | A | A | A | A | A | A | B45 | A129K | 1.69 | A129W | 1.32 | A129L | 1.56 | A129P | 1.38 | A129V | 1.23 |
| 130 | S | Helix | | 37 | S | S | S | S | G | G | D | | | | | | | | | | | |
| 131 | F | Helix | | 2 | F | F | F | F | Y | Y | F | | | | | | | | | | | |
| 132 | R | Helix | | 95 | R | R | R | R | R | R | R | | | | | | | | | | | |
| 133 | A | Helix | | 49 | A | A | A | A | S | S | A | | | | | | | | | | | |
| 134 | Y | Helix | | 1 | Y | Y | Y | Y | Y | Y | Y | | | | | | | | | | | |
| 135 | Q | Helix | | 24 | Q | Q | Q | Q | Q | Q | Q | | | | | | | | | | | |
| 136 | Q | Helix | | 77 | Q | Q | Q | Q | Q | Q | Q | B45 | Q136I | 1.52 | Q136F | 1.34 | Q136I | 1.31 | | | | |
| 137 | S | Helix | | 5 | S | S | S | S | A | A | S | | | | | | | | | | | |
| 138 | L | Helix | | 10 | L | L | L | L | L | L | L | | | | | | | | | | | |
| 139 | E | Helix | | 55 | E | E | E | D | E | E | E | | | | | | | | | | | |
| 140 | D | Helix | | 77 | D | D | D | D | T | T | D | B45 | D140E | 1.65 | | | | | | | | |
| 141 | W | Helix | | 6 | W | W | W | W | W | W | W | | | | | | | | | | | |
| 142 | L | Helix | | 67 | L | L | L | L | L | L | L | | | | | | | | | | | |
| 143 | E | Helix | | 76 | E | E | E | E | D | D | E | B45 | E143S | 2.18 | E143R | 1.69 | E143G | 1.78 | E143Y | 1.64 | E143M | 1.62 |
| | | | | | | | | | | | | | E143Q | 1.58 | E143L | 1.58 | E143W | 1.55 | E143T | 1.5 | E143A | 1.48 |
| | | | | | | | | | | | | | E143N | 1.37 | E143P | 1.37 | | 1.34 | | | | |
| 144 | N | Coil | | 62 | N | N | N | N | N | N | N | B45 | N144M | 1.81 | N144A | 1.56 | N144T | 1.21 | | | | |
| 145 | R | Coil | | 67 | R | R | R | R | R | R | R | B45 | R145N | 1.81 | R145P | 1.55 | R145A | 1.45 | R145L | 1.44 | R145S | 1.23 |
| 146 | D | Coil | | 85 | D | D | D | D | D | D | D | B45 | D146W | 1.53 | D146T | 1.3 | D146H | 1.22 | D146V | 1.21 | | |
| 147 | D | Coil | a4 | 31 | D | D | D | D | D | D | D | B45 | N147V | 1.77 | N147R | 1.65 | N147D | 1.42 | N147S | 1.37 | | |
| 148 | A | Helix | | 64 | A | A | A | A | A | A | A | B45 | A148F | 2.22 | A148W | 1.83 | A148P | 1.75 | A148N | 1.74 | A148L | 1.73 |
| 149 | R | Helix | | 80 | R | R | R | R | R | R | R | B45 | R149V | 2.2 | R149A | 1.89 | R149S | 1.88 | R149L | 1.49 | | |
| 150 | T | Helix | | 22 | T | T | T | T | T | T | T | | | | | | | | | | | |
| 151 | R | Helix | | 57 | R | R | R | R | R | R | R | | | | | | | | | | | |
| 152 | S | Helix | | 93 | S | S | S | S | S | S | S | | | | | | | | | | | |
| 153 | V | Helix | | 65 | V | V | V | V | I | I | S | | | | | | | | | | | |
| 154 | L | Helix | | 0 | L | L | L | L | L | L | L | | | | | | | | | | | |
| 155 | Y | Helix | | 42 | Y | Y | Y | Y | Y | Y | Y | | | | | | | | | | | |
| 156 | T | Helix | | 77 | T | T | T | T | T | T | T | | | | | | | | | | | |
| 157 | Q | Helix | | 31 | Q | Q | Q | Q | R | R | Q | | | | | | | | | | | |
| 158 | Y | Helix | | 3 | Y | Y | Y | Y | Y | Y | Y | B45 | Y158F | 1.7 | | | | | | | | |
| 159 | I | Helix | | 31 | Y | Y | Y | Y | Y | Y | I | B45 | I159V | 1.37 | | | | | | | | |
| 160 | A | Helix | | 72 | V | I | I | I | V | V | A | B45 | A160V | 1.65 | | | | | | | | |
| 161 | L | Helix | | 0 | A | L | L | L | A | A | L | | | | | | | | | | | |
| 162 | E | Helix | | 13 | L | E | E | E | L | L | L | | | | | | | | | | | |
| 163 | D | Helix | | 87 | E | D | D | D | D | D | D | | | | | | | | | | | |
| 164 | F | Helix | | 29 | D | F | F | F | D | D | D | | | | | | | | | | | |
| 165 | L | Helix | | 2 | F | L | L | L | I | I | F | | | | | | | | | | | |
| 166 | L | Helix | | 89 | L | L | L | L | T | T | L | B45 | L166E | 1.67 | L166C | 1.34 | L166I | 1.28 | L166T | 1.25 | | |
| 167 | N | Helix | | 56 | N | N | N | N | N | N | N | B45 | N167M | 1.43 | N167Q | 1.3 | N167L | 1.29 | N167A | 1.22 | | |
| 168 | A | Helix | | 16 | A | A | A | A | A | A | A | | | | | | | | | | | |
| 169 | M | Helix | | 10 | M | M | M | M | I | I | M | | | | | | | | | | | |
| 170 | P | Helix | | 70 | P | P | P | P | P | P | P | | | | | | | | | | | |
| 171 | L | Helix | | 30 | L | L | L | L | L | L | L | | | | | | | | | | | |
| 172 | F | Turn | | 4 | F | F | F | F | F | F | F | | | | | | | | | | | |
| 173 | A | Coil | | 48 | A | A | A | A | I | I | A | B45 | A173F | 1.56 | A173T | 1.56 | | | | | | |
| 174 | I | Coil | | 45 | I | I | I | I | R | R | I | | | | | | | | | | | |
| 175 | N | Turn | | 118 | N | N | N | N | R | R | R | | | | | | | | | | | |

TABLE 4-continued

| MP258 position | a.a. | 2D Struc | 2D Assign | Sol. Exp. | MP258 | B21 | B25 | B45 | Bd | Bh | Bi | backbone | Variant | FAE | Variant | FAE | Variant | FAE | Variant | FAE |
|---|---|---|---|---|---|---|---|---|---|---|---|---|---|---|---|---|---|---|---|---|
| 176 | N |  |  | 112 | N | N | N | N | N | N | E |  |  |  |  |  |  |  |  |  |
| 177 | Q | Turn |  | 12 | Q | Q | Q | Q | E | Q | Q | B45 | Q177C | 1.78 | Q177S | 1.48 | Q177T | 1.3 | Q177P | 1.21 |
| 178 | Q | Coil |  | 16 | Q | Q | Q | Q | E | E | E | B45 | Q178K | 1.69 |  |  |  |  |  |  |
| 179 | V | Turn |  | 21 | V | V | V | V | V | V | V | B45 | V179I | 2.06 | V179L | 1.67 |  |  |  |  |
| 180 | P | Turn |  | 2 | P | P | P | P | P | P | P | B45 | P180A | 1.7 | P180S | 1.51 | P180L | 1.51 | P180M | 1.38 |
| 181 | L | Turn |  | 3 | L | L | L | L | L | L | L |  |  |  |  |  |  |  |  |  |
| 182 | L | Helix | a5 | 0 | L | L | L | L | L | L | L |  |  |  |  |  |  |  |  |  |
| 183 | M | Helix |  | 1 | M | M | M | M | M | M | M |  |  |  |  |  |  |  |  |  |
| 184 | V | Helix |  | 1 | V | V | V | V | V | V | V |  |  |  |  |  |  |  |  |  |
| 185 | Y | Helix |  | 6 | Y | Y | Y | Y | Y | Y | Y |  |  |  |  |  |  |  |  |  |
| 186 | A | Helix |  | 0 | A | A | A | A | A | A | A |  |  |  |  |  |  |  |  |  |
| 187 | Q | Helix |  | 2 | Q | Q | Q | Q | Q | Q | Q |  |  |  |  |  |  |  |  |  |
| 188 | A | Helix |  | 1 | A | A | A | A | A | A | A |  |  |  |  |  |  |  |  |  |
| 189 | A | Helix |  | 0 | A | A | A | A | A | A | A |  |  |  |  |  |  |  |  |  |
| 190 | N | Helix |  | 1 | N | N | N | N | N | N | N |  |  |  |  |  |  |  |  |  |
| 191 | L | Helix |  | 5 | L | L | L | L | L | L | L |  |  |  |  |  |  |  |  |  |
| 192 | H | Helix |  | 0 | H | H | H | H | H | H | H |  |  |  |  |  |  |  |  |  |
| 193 | L | Helix |  | 1 | L | L | L | L | L | L | L |  |  |  |  |  |  |  |  |  |
| 194 | L | Helix |  | 5 | L | L | L | L | L | L | L |  |  |  |  |  |  |  |  |  |
| 195 | L | Helix |  | 0 | L | L | L | L | L | L | L |  |  |  |  |  |  |  |  |  |
| 196 | L | Helix |  | 0 | L | L | L | L | L | L | L |  |  |  |  |  |  |  |  |  |
| 197 | R | Helix |  | 7 | R | R | R | R | R | R | R |  |  |  |  |  |  |  |  |  |
| 198 | D | Helix |  | 0 | D | D | D | D | D | D | D |  |  |  |  |  |  |  |  |  |
| 199 | A | Helix |  | 2 | A | A | A | A | A | A | A |  |  |  |  |  |  |  |  |  |
| 200 | S | Helix |  | 10 | S | S | S | S | S | S | S |  |  |  |  |  |  |  |  |  |
| 201 | L | Helix |  | 16 | L | L | L | L | L | L | L | B45 | L201V | 1.27 |  |  |  |  |  |  |
| 202 | F | Turn |  | 9 | F | F | F | F | F | F | Y |  |  |  |  |  |  |  |  |  |
| 203 | G | Turn |  | 0 | G | G | G | G | G | G | R |  |  |  |  |  |  |  |  |  |
| 204 | S | Coil |  | 101 | S | S | S | S | S | S | E |  |  |  |  |  |  |  |  |  |
| 205 | E | Turn |  | 66 | E | E | E | E | E | E | F |  |  |  |  |  |  |  |  |  |
| 206 | F | Turn |  | 3 | F | F | F | F | W | W | L | B45 | F206L | 2.37 | F206I | 1.47 | F206T | 1.46 | F206W | 1.45 |
| 207 | G | Turn |  | 88 | G | G | G | G | G | G | G |  |  |  |  |  |  |  |  |  |
| 208 | L | Coil |  | 12 | L | L | L | L | M | T | T |  |  |  |  |  |  |  |  |  |
| 209 | T | Coil |  | 87 | T | T | T | T | A | A | T | B45 | T209E | 1.86 | T209R | 1.7 | T209D | 1.66 | T209L | 1.59 | T209V | 1.3 |
|  |  |  |  |  |  |  |  |  |  |  |  |  | T209C | 1.22 |  |  |  |  |  |  |
| 210 | S | Helix | a6 | 126 | S | S | S | S | S | S | S | B45 | S210P | 2.15 | S210T | 1.78 | S210I | 1.46 | S210R | 1.25 |
| 211 | Q | Helix |  | 95 | Q | Q | Q | Q | Q | S | Q | B45 | Q211I | 1.9 | Q211R | 1.74 | Q211G | 1.55 | Q211T | 1.44 | Q211P | 1.33 |
|  |  |  |  |  |  |  |  |  |  |  |  |  | Q211L | 1.22 |  |  |  |  |  |  |
| 212 | E | Helix |  | 40 | E | E | E | E | D | D | E |  |  |  |  |  |  |  |  |  |
| 213 | I | Helix |  | 35 | I | I | I | I | V | V | I | B45 | I213V | 1.71 | I213T | 1.66 | I213L | 1.64 | I213M | 1.53 | I213Q | 1.5 |
|  |  |  |  |  |  |  |  |  |  |  |  |  | I213N | 1.28 | I213G | 1.21 |  |  |  |  |
| 214 | Q | Helix |  | 58 | Q | Q | Q | Q | N | N | Q | B21 | Q214W | 3.46 |  |  |  |  |  |  |
| 215 | R | Helix |  | 82 | R | R | R | R | Q | Q | R |  |  |  |  |  |  |  |  |  |
| 216 | Y | Helix |  | 1 | Y | Y | Y | Y | Y | Y | Y |  |  |  |  |  |  |  |  |  |
| 217 | Y | Helix |  | 17 | Y | Y | Y | Y | Y | Y | Y |  |  |  |  |  |  |  |  |  |
| 218 | E | Helix |  | 86 | E | E | E | E | Q | Q | E | B45 | E218T | 1.76 | E218A | 1.65 | E218H | 1.62 | E218S | 1.55 | E218I | 1.51 |
|  |  |  |  |  |  |  |  |  |  |  |  |  | E218V | 1.33 | E218Y | 1.29 | E218W | 1.21 | E218D | 1.21 |  |  |
| 219 | R | Helix |  | 28 | R | R | R | R | E | E | R | B21 | R219N | 1.63 |  |  |  |  |  |  |
| 220 | Q | Helix |  | 6 | Q | Q | Q | Q | Q | Q | Q |  |  |  |  |  |  |  |  |  |

TABLE 4-continued

| MP258 position | a.a. | 2D Struc | 2D Assign | Sol. Exp. | MP258 | B21 | B25 | B45 | Bd | Bh | Bi | backbone | Variant | FAE | Variant | FAE | Variant | FAE | Variant | FAE | Variant | FAE |
|---|---|---|---|---|---|---|---|---|---|---|---|---|---|---|---|---|---|---|---|---|---|---|
| 221 | A | Helix | | 66 | A | A | A | A | I | I | V | B45 | A221L | 2.21 | A221Y | 1.86 | A221V | 1.84 | A221K | 1.81 | A221I | 1.62 |
| | | | | | | | | | | | | | A221D | 1.48 | A221G | 1.43 | A221H | 1.43 | A221W | 1.42 | A221R | 1.28 |
| | | | | | | | | | | | | | A221T | 1.25 | | | | | | | | |
| 222 | E | Helix | | 70 | E | E | E | E | E | E | E | B45 | E222G | 1.89 | E222M | 1.75 | E222K | 1.72 | E222T | 1.67 | E222D | 1.39 |
| | | | | | | | | | | | | | E222I | 1.36 | | | | | | | | |
| 223 | K | Helix | | 16 | K | K | K | K | Y | Y | R | | | | | | | | | | | |
| 224 | T | Helix | | 33 | T | T | T | T | T | T | T | | | | | | | | | | | |
| 225 | R | Helix | | 67 | R | R | R | R | E | E | R | B45 | R225Q | 4.65 | R225M | 2.37 | R225V | 2.32 | R225F | 2.07 | R225L | 2.04 |
| | | | | | | | | | | | | | R225G | 1.58 | R225I | 1.58 | R225Y | 1.55 | R225C | 1.54 | R225N | 1.46 |
| 226 | E | Helix | | 66 | E | E | E | E | E | E | D | B45 | E226D | 2.17 | E226S | 2.13 | E226V | 1.68 | E226C | 1.52 | E226Y | 1.46 |
| | | | | | | | | | | | | | E226R | 1.33 | E226A | 1.24 | | | | | | |
| 227 | Y | Helix | | 3 | Y | Y | Y | Y | Y | Y | Y | | | | | | | | | | | |
| 228 | S | Helix | | 11 | S | S | S | S | S | S | S | | | | | | | | | | | |
| 229 | D | Helix | | 31 | D | D | D | D | N | N | D | | | | | | | | | | | |
| 230 | Y | Helix | | 17 | Y | Y | Y | Y | H | H | H | B45 | Y230A | 2.65 | Y230L | 1.83 | Y230S | 1.22 | | | | |
| 231 | C | Helix | | 1 | C | C | C | C | C | C | C | | | | | | | | | | | |
| 232 | A | Helix | | 27 | A | A | A | A | V | V | C | | | | | | | | | | | |
| 233 | R | Helix | | 87 | R | R | R | R | Q | Q | Q | B45 | R233K | 2.13 | R233D | 1.96 | R233Q | 1.91 | R233G | 1.56 | R233I | 1.41 |
| | | | | | | | | | | | | | R233A | 1.26 | R233Y | 1.2 | | | | | | |
| 234 | W | Helix | | 31 | W | W | W | W | W | W | W | B45 | W234M | 2.15 | W234L | 2.06 | W234I | 1.87 | W234I | 1.57 | W234A | 1.55 |
| | | | | | | | | | | | | | W234R | 1.55 | W234F | 1.52 | W234Y | 1.48 | W234S | 1.22 | | |
| 235 | Y | Helix | | 12 | Y | Y | Y | Y | Y | Y | Y | | | | | | | | | | | |
| 236 | N | Helix | | 71 | N | N | N | N | N | N | N | B45 | N236E | 2.2 | N236K | 1.87 | N236S | 1.43 | N236T | 1.41 | N236L | 1.41 |
| 237 | T | Helix | | 50 | T | T | T | T | T | T | T | | | | | | | | | | | |
| 238 | G | Helix | | 8 | G | G | G | G | G | G | G | | | | | | | | | | | |
| 239 | L | Helix | | 19 | L | L | L | L | L | L | L | | | | | | | | | | | |
| 240 | N | Helix | | 100 | N | N | N | N | N | N | N | B45 | N240Y | 1.77 | N240A | 1.56 | N240M | 1.53 | N240S | 1.5 | N240T | 1.49 |
| | | | | | | | | | | | | | N240G | 1.46 | N240K | 1.46 | N240F | 1.36 | N240L | 1.28 | N240R | 1.26 |
| | | | | | | | | | | | | | N240W | 1.22 | N240C | 1.22 | | | | | | |
| 241 | N | Helix | | 92 | N | N | N | N | N | N | N | B45 | N241S | 1.68 | N241I | 1.62 | N241M | 1.57 | N241W | 1.5 | N241K | 1.48 |
| | | | | | | | | | | | | | N241Y | 1.33 | N241V | 1.27 | N241C | 1.21 | | | | |
| 242 | L | Helix | | 13 | L | L | L | L | L | L | L | B45 | L242P | 2.07 | L242V | 1.7 | | | | | | |
| 243 | R | Coil | a7 | 76 | R | R | R | R | R | R | R | B45 | R243M | 2.3 | R243V | 2 | R243T | 1.84 | R243C | 1.75 | R243K | 1.72 |
| | | | | | | | | | | | | B45 | R243I | 1.68 | R243Q | 1.59 | R243S | 1.54 | | | | |
| 244 | G | Coil | | 46 | G | G | G | G | G | G | G | | | | | | | | | | | |
| 245 | T | Coil | | 107 | T | T | T | T | T | T | T | B45 | T245Q | 2.71 | T245Y | 2.46 | T245G | 2.4 | T245Y | 2.13 | T245A | 2.03 |
| | | | | | | | | | | | | | T245I | 1.96 | T245W | 1.95 | T245S | 1.91 | T245W | 1.89 | T245M | 1.82 |
| | | | | | | | | | | | | | T245D | 1.82 | T245N | 1.73 | T245V | 1.64 | T245R | 1.66 | T245F | 1.34 |
| 246 | N | Coil | | 57 | N | N | N | N | N | N | N | B45 | N246S | 1.73 | N246S | 1.66 | N246Q | 1.66 | N246T | 1.64 | | |
| 247 | A | Helix | | 0 | A | A | A | A | A | A | A | B45 | A247E | 1.73 | A247T | 1.57 | A247P | 1.53 | | | | |
| | | | | | | | | | | | | | A247S | 1.55 | | | | | | | | |
| 248 | E | Helix | | 60 | E | E | E | E | E | E | E | B45 | E248S | 2.17 | E248T | 1.73 | E248L | 1.53 | E248Y | 1.49 | | |
| | | | | | | | | | | | | | E248V | 1.42 | E248N | 1.42 | E248F | 1.24 | E248R | 1.24 | | |
| 249 | S | Helix | | 58 | S | S | S | S | S | S | S | | | | | | | | | | | |
| 250 | W | Helix | | 1 | W | W | W | W | W | W | W | | | | | | | | | | | |
| 251 | L | Helix | | 31 | L | L | L | L | R | R | R | | | | | | | | | | | |
| 252 | R | Helix | | 67 | R | R | R | R | R | R | R | B45 | R252N | 1.47 | R252F | 1.4 | R252A | 1.24 | | | | |
| 253 | Y | Helix | | 20 | Y | Y | Y | Y | Y | Y | Y | | | | | | | | | | | |
| 254 | N | Helix | | 0 | N | N | N | N | N | N | N | | | | | | | | | | | |
| 255 | Q | Helix | | 37 | Q | Q | Q | Q | Q | Q | Q | | | | | | | | | | | |
| 256 | F | Helix | | 0 | F | F | F | F | F | F | F | | | | | | | | | | | |
| 257 | R | Helix | | 23 | R | R | R | R | R | R | R | | | | | | | | | | | |

TABLE 4-continued

| MP258 position | a.a. | 2D Struc | 2D Assign | Sol. Exp. | MP258 | B21 | B25 | B45 | Bd | Bh | Bi | backbone | Variant | FAE | Variant | FAE | Variant | FAE | Variant | FAE | Variant | FAE |
|---|---|---|---|---|---|---|---|---|---|---|---|---|---|---|---|---|---|---|---|---|---|---|
| 258 | R | Helix | | 2 | R | R | R | R | R | R | R | | | | | | | | | | | |
| 259 | D | Helix | | 7 | D | D | D | D | D | D | D | | | | | | | | | | | |
| 260 | L | Helix | | 0 | L | L | L | L | L | L | L | | | | | | | | | | | |
| 261 | T | Helix | | 20 | T | T | T | T | T | T | T | | | | | | | | | | | |
| 262 | L | Helix | | 2 | L | L | L | L | L | L | L | | | | | | | | | | | |
| 263 | G | Helix | | 13 | G | G | G | G | G | G | G | | | | | | | | | | | |
| 264 | V | Turn | | 0 | V | V | V | V | V | V | V | | | | | | | | | | | |
| 265 | L | Helix | | 15 | L | L | L | L | L | L | L | | | | | | | | | | | |
| 266 | D | Helix | | 6 | D | D | D | D | D | D | D | | | | | | | | | | | |
| 267 | L | Helix | | 6 | L | L | L | L | L | L | L | | | | | | | | | | | |
| 268 | V | Helix | | 3 | V | V | V | V | V | V | V | | | | | | | | | | | |
| 269 | A | Helix | | 7 | A | A | A | A | A | A | A | | | | | | | | | | | |
| 270 | L | Turn | | 9 | L | L | L | L | L | L | L | | | | | | | | | | | |
| 271 | F | Turn | | 0 | F | F | F | F | F | F | F | | | | | | | | | | | |
| 272 | P | Helix | | 29 | P | P | P | P | P | P | P | | | | | | | | | | | |
| 273 | S | Helix | | 2 | s | S | S | S | S | S | S | | | | | | | | | | | |
| 274 | Y | Helix | | 0 | Y | Y | Y | Y | Y | Y | Y | | | | | | | | | | | |
| 275 | D | Coil | | 22 | D | D | D | D | D | D | D | | | | | | | | | | | |
| 276 | T | Turn | | 30 | T | T | T | T | T | T | T | | | | | | | | | | | |
| 277 | R | Turn | | 58 | R | R | R | R | R | R | R | B45 | R277Q | 1.35 | R277G | | R277V | 1.23 | | | | |
| 278 | I | Turn | | 44 | I | I | I | I | T | T | L | | | | | | | | | | | |
| 279 | Y | Coil | | 4 | Y | Y | Y | Y | Y | Y | Y | | | | | | | | | | | |
| 280 | P | Coil | | 30 | P | P | P | P | P | P | P | B45 | P280H | 1.54 | P280C | 1.32 | P280T | 1.29 | | | | |
| 281 | I | Coil | | 39 | I | I | I | I | I | I | I | B45 | I281Q | 2.16 | I281M | 1.93 | I281R | 1.46 | I281K | 1.35 | I281S | 1.31 |
|  |  |  |  |  |  |  |  |  |  |  |  |  | I281H | 1.29 | I281A | 1.23 | | | | | | |
| 282 | N | Coil | | 42 | N | N | N | N | N | N | N | | | | | | | | | | | |
| 283 | T | Sheet | | 0 | T | T | T | T | T | T | T | | | | | | | | | | | |
| 284 | S | Sheet | b1 | 72 | S | S | S | S | S | S | S | | | | | | | | | | | |
| 285 | A | Coil | | 8 | A | A | A | A | A | A | A | | | | | | | | | | | |
| 286 | Q | Coil | | 6 | Q | Q | Q | Q | Q | Q | Q | | | | | | | | | | | |
| 287 | L | Coil | | 9 | L | L | L | L | L | L | L | | | | | | | | | | | |
| 288 | T | Coil | | 2 | T | T | T | T | T | T | T | | | | | | | | | | | |
| 289 | R | Coil | | 8 | R | R | R | R | R | R | R | | | | | | | | | | | |
| 290 | E | Sheet | | 11 | E | E | E | E | E | E | E | | | | | | | | | | | |
| 291 | I | Sheet | | 1 | I | I | I | I | I | I | V | | | | | | | | | | | |
| 292 | Y | Sheet | | 7 | Y | Y | Y | Y | Y | Y | Y | | | | | | | | | | | |
| 293 | T | Coil | | 8 | T | T | T | T | T | T | T | | | | | | | | | | | |
| 294 | D | Coil | | 24 | D | D | D | D | D | D | D | | | | | | | | | | | |
| 295 | P | Coil | | 4 | P | P | P | P | P | P | A | | | | | | | | | | | |
| 296 | I | Coil | | 3 | I | I | I | I | I | I | I | | | | | | | | | | | |
| 297 | G | Coil | | 15 | G | G | G | G | G | G | G | | | | | | | | | | | |
| 298 | R | Coil | | 16 | R | R | R | R | R | T | G | | | | | | | | | | | |
| 299 | T | Coil | | 48 | T | T | T | T | T | T | T | | | | | | | | | | | |
| 300 | N | Coil | | 59 | N | N | N | N | N | H | G | | | | | | | | | | | |
| 301 | A | Coil | | 109 | A | A | A | A | A | P | N | | | | | | | | | | | |
| 302 | P | Coil | | 63 | P | P | P | P | P | S | — | | | | | | | | | | | |
| 303 | S | Coil | | 0 | s | S | S | S | S | Q | — | 258 | S303N | 1.28 | S303P | 1.24 | | | | | | |
| 304 | G | Coil | | 67 | G | G | G | G | G | A | M | | | | | | | | | | | |
| 305 | F | Coil | | 78 | F | F | F | F | F | A | A | | | | | | | | | | | |
| 306 | A | Coil | | 31 | A | A | A | A | A | A | A | 258 | A306G | 1.47 | A306T | 2.10 | | | | | | |
| 307 | S | Coil | | 11 | S | S | S | S | S | S | S | | | | | | | | | | | |

TABLE 4-continued

| MP258 position | a.a. | 2D Struc | 2D Assign | Sol. Exp. | MP258 | B21 | B25 | B45 | Bd | Bh | Bi | backbone | Variant | FAE | Variant | FAE | Variant | FAE | Variant | FAE | Variant | FAE |
|---|---|---|---|---|---|---|---|---|---|---|---|---|---|---|---|---|---|---|---|---|---|---|
| 308 | T | Coil | | 29 | T | T | T | T | T | T | M | | | | | | | | | | | |
| 309 | N | Coil | | 20 | N | N | N | N | N | N | N | | | | | | | | | | | |
| 310 | W | Helix | | 5 | W | W | W | W | W | W | W | | | | | | | | | | | |
| 311 | F | Helix | | 8 | F | F | F | F | F | F | Y | | | | | | | | | | | |
| 312 | N | Helix | | 48 | N | N | N | N | N | N | N | | | | | | | | | | | |
| 313 | N | Coil | | 60 | N | N | N | N | N | N | N | | | | | | | | | | | |
| 314 | N | Coil | | 96 | N | N | N | N | N | N | N | | | | | | | | | | | |
| 315 | A | Coil | | 0 | A | A | A | A | A | A | A | | | | | | | | | | | |
| 316 | P | Coil | | 33 | P | P | P | P | P | P | P | | | | | | | | | | | |
| 317 | P | Coil | | 65 | P | P | P | P | P | P | P | | | | | | | | | | | |
| 318 | F | Helix | a8 | 6 | F | F | F | F | F | F | F | | | | | | | | | | | |
| 319 | S | Helix | | 96 | S | S | S | S | S | S | S | | | | | | | | | | | |
| 320 | A | Helix | | 58 | A | A | A | A | A | A | A | | | | | | | | | | | |
| 321 | I | Helix | | 4 | I | I | I | I | I | I | I | | | | | | | | | | | |
| 322 | E | Helix | | 39 | E | E | E | E | E | E | E | | | | | | | | | | | |
| 323 | A | Helix | | 98 | A | A | A | A | A | A | T | | | | | | | | | | | |
| 324 | A | Helix | | 52 | A | A | A | A | A | A | A | | | | | | | | | | | |
| 325 | V | Helix | | 18 | V | I | I | I | I | V | V | | | | | | | | | | | |
| 326 | I | Coil | | 24 | I | F | F | F | F | I | I | | | | | | | | | | | |
| 327 | R | Coil | | 11 | R | R | R | R | R | R | R | | | | | | | | | | | |
| 328 | P | Coil | | 77 | P | P | P | P | P | P | P | | | | | | | | | | | |
| 329 | P | Coil | | 53 | P | P | P | P | P | P | P | | | | | | | | | | | |
| 330 | H | Coil | | 21 | H | H | H | H | H | H | H | | | | | | | | | | | |
| 331 | L | Coil | | 17 | L | L | L | L | L | L | L | | | | | | | | | | | |
| 332 | L | Coil | | 3 | L | L | L | L | L | L | L | | | | | | | | | | | |
| 333 | D | Sheet | | 21 | D | D | D | D | D | D | D | | | | | | | | | | | |
| 334 | F | Sheet | | 6 | F | F | F | F | F | F | F | | | | | | | | | | | |
| 335 | P | Sheet | | 13 | P | P | P | P | P | P | P | | | | | | | | | | | |
| 336 | E | Coil | | 19 | E | E | E | E | E | E | L | | | | | | | | | | | |
| 337 | Q | Sheet | b2 | 48 | Q | Q | Q | Q | Q | Q | Q | | | | | | | | | | | |
| 338 | L | Sheet | | 11 | L | L | L | L | L | L | L | | | | | | | | | | | |
| 339 | T | Sheet | | 13 | I | T | T | T | T | T | K | | | | | | | | | | | |
| 340 | I | Sheet | | 0 | I | I | I | I | I | I | I | | | | | | | | | | | |
| 341 | F | Sheet | | 30 | F | Y | Y | Y | Y | Y | F | | | | | | | | | | | |
| 342 | S | Sheet | | 5 | S | S | S | S | S | S | S | | | | | | | | | | | |
| 343 | V | Sheet | | 29 | V | A | A | A | A | T | A | | | | | | | | | | | |
| 344 | L | Sheet | | 88 | L | S | S | S | S | L | S | | | | | | | | | | | |
| 345 | S | Sheet | | 39 | S | S | S | S | S | S | S | 258 | S345N | 1.74 | | | | | | | | | |
| 346 | R | Sheet | | 67 | R | R | R | R | R | R | R | | | | | | | | | | | |
| 347 | W | Sheet | | 41 | W | W | W | W | W | W | W | | | | | | | | | | | |
| 348 | S | Turn | L1 | 51 | S | S | S | S | S | S | S | | | | | | | | | | | |
| 349 | N | Turn | | 113 | N | S | S | S | S | N | N | | | | | | | | | | | |
| 350 | T | Turn | | 78 | T | T | T | T | T | T | T | | | | | | | | | | | |
| 351 | Q | Sheet | b3 | 36 | Q | Q | Q | Q | Q | Q | R | | | | | | | | | | | |
| 352 | Y | Sheet | | 45 | Y | H | H | H | H | F | H | | | | | | | | | | | |
| 353 | M | Sheet | | 0 | M | M | M | M | M | M | M | | | | | | | | | | | |
| 354 | N | Sheet | | 19 | N | N | N | N | N | N | T | | | | | | | | | | | |
| 355 | Y | Sheet | | 4 | Y | Y | Y | Y | Y | I | Y | | | | | | | | | | | |
| 356 | Y | Sheet | | 1 | Y | Y | Y | Y | Y | Y | Y | | | | | | | | | | | |
| 357 | V | Coil | | 9 | V | W | W | W | V | A | R | | | | | | | | | | | |
| 358 | G | Sheet | | 0 | G | G | G | G | G | G | G | | | | | | | | | | | |

TABLE 4-continued

| MP258 position | a.a. | 2D Struc | 2D Assign | Sol. Exp. | MP258 | B21 | B25 | B45 | Bd | Bh | Bi | backbone | Variant | FAE | Variant | FAE | Variant | FAE | Variant | FAE |
|---|---|---|---|---|---|---|---|---|---|---|---|---|---|---|---|---|---|---|---|---|
| 359 | H | Sheet | | 0 | H | H | H | H | H | H | H | | | | | | | | | |
| 360 | R | Sheet | | 61 | R | R | R | R | R | R | T | B21 | R360S | 1.68 | R360N | 1.57 | R360T | 1.38 | R360Y | 1.29 | R360M | 1.23 |
| 361 | L | Sheet | | 13 | L | L | L | L | L | L | I | | | | | | | | | |
| 362 | E | Sheet | | 20 | E | N | N | N | N | N | Q | B21 | N362Y<br>N362D<br>N362E | 2.25<br>1.45<br>1.26 | N362H<br>N362V | 1.79<br>1.45 | N362W<br>N362A | 1.64<br>1.32 | N362K<br>N362L | 1.57<br>1.3 | N362I<br>N362G | 1.57<br>1.26 |
| 363 | S | Sheet | | 8 | S | F | F | F | F | S | S | | | | | | | | | |
| 364 | R | Sheet | | 40 | R | R | R | R | R | R | R | | | | | | | | | |
| 365 | T | Sheet | | 10 | T | P | P | P | P | P | P | | | | | | | | | |
| 366 | I | Turn | | 1 | I | I | I | I | I | I | I | | | | | | | | | |
| 367 | R | Turn | | 70 | R | G | G | G | G | A | R | B21 | G367H<br>G367L | 3.17<br>1.58 | G367Q<br>G367Y | 2.72<br>1.45 | G367N<br>G367I | 1.97<br>1.37 | G367W<br>G367A | 1.84<br>1.36 | G367T | 1.62 |
| 368 | G | Coil | | 21 | G | G | G | G | G | G | G | | | | | | | | | |
| 369 | S | Coil | | 116 | S | T | T | T | T | S | A | | | | | | | | | |
| 370 | L | Sheet | b4 | 37 | L | L | L | L | L | L | L | | | | | | | | | |
| 371 | S | Sheet | | 117 | S | N | N | N | N | N | I | | | | | | | | | |
| 372 | T | Sheet | | 29 | T | T | T | T | T | T | T | | | | | | | | | |
| 373 | S | Sheet | | 45 | S | S | S | S | S | S | S | | | | | | | | | |
| 374 | T | Sheet | | 63 | T | H | H | H | Q | Q | H | | | | | | | | | |
| 375 | H | Sheet | | 29 | H | G | G | G | G | G | G | | | | | | | | | |
| 376 | G | Coil | | 23 | G | A | A | L | L | S | N | | | | | | | | | |
| 377 | N | Coil | | 80 | N | T | T | T | T | T | I | | | | | | | | | |
| 378 | T | Coil | | 24 | T | N | N | N | N | N | T | | | | | | | | | |
| 379 | N | Coil | | 106 | N | Z | Z | Z | Z | Z | Z | | | | | | | | | |
| — | | | | | | | | | | | | | | | | | | | | | |
| 380 | T | Coil | | 74 | T | T | T | T | T | T | T | | | | | | | | | |
| 381 | S | Coil | | 124 | S | S | S | S | S | S | S | | | | | | | | | |
| 382 | I | Coil | | 20 | I | I | I | I | I | I | I | | | | | | | | | |
| 383 | N | Sheet | b5 | 76 | N | N | N | N | N | N | N | | | | | | | | | |
| 384 | P | Sheet | | 66 | P | P | P | P | P | P | P | | | | | | | | | |
| 385 | V | Sheet | | 42 | V | V | V | V | V | V | V | | | | | | | | | |
| 386 | T | Sheet | | 99 | T | T | T | T | T | T | T | | | | | | | | | |
| 387 | L | Coil | | 5 | L | L | L | L | L | L | F | | | | | | | | | |
| 388 | Q | Sheet | | 109 | Q | Q | Q | Q | Q | Q | Q | | | | | | | | | |
| 389 | F | Coil | b6 | 3 | F | F | F | F | F | F | F | | | | | | | | | |
| 390 | T | Turn | | 66 | T | T | T | T | T | T | P | | | | | | | | | |
| 391 | S | Turn | | 56 | S | S | S | S | S | S | S | | | | | | | | | |
| 392 | R | Coil | | 28 | R | R | R | R | R | R | R | | | | | | | | | |
| 393 | D | Sheet | | 3 | D | D | D | D | D | D | D | | | | | | | | | |
| 394 | V | Sheet | | 1 | V | Y | Y | Y | Y | I | V | | | | | | | | | |
| 395 | Y | Coil | | 8 | Y | Y | Y | Y | Y | Y | Y | | | | | | | | | |
| 396 | R | Sheet | | 31 | R | R | R | R | R | R | R | | | | | | | | | |
| 397 | T | Sheet | | 6 | T | T | T | T | T | T | T | | | | | | | | | |
| 398 | E | Sheet | | 35 | E | E | E | E | E | E | E | | | | | | | | | |
| 399 | S | Sheet | | 3 | S | Y | Y | Y | Y | S | S | | | | | | | | | |
| 400 | Y | Sheet | | 35 | Y | Y | Y | Y | Y | L | Y | | | | | | | | | |
| 401 | A | Sheet | | 1 | A | A | A | A | A | A | A | | | | | | | | | |
| 402 | G | Sheet | | 0 | G | G | G | G | G | Y | G | | | | | | | | | |
| 403 | I | Sheet | | 0 | I | I | I | I | I | L | V | | | | | | | | | |
| 404 | N | Sheet | | 0 | N | N | N | N | N | N | L | 258 | N404 H | 3.45 | | | | | | | |
| 405 | I | Sheet | | 53 | I | I | I | I | I | I | L | | | | | | | | | |

TABLE 4-continued

| MP258 position | a.a. | 2D Struc | 2D Assign | Sol. Exp. | MP258 | B21 | B25 | B45 | Bd | Bh | Bi | backbone | Variant | FAE | Variant | FAE | Variant | FAE | Variant | FAE | Variant | FAE |
|---|---|---|---|---|---|---|---|---|---|---|---|---|---|---|---|---|---|---|---|---|---|---|
| 406 | L | Coil | L2 | 38 | L | L | L | L | L | F | W | 258 | L406M | 1.65 | | | | | | | | |
| — | — | | | | — | — | — | — | — | — | G | | | | | | | | | | | |
| 407 | L | Coil | | 114 | L | L | L | L | F | I | I | 258 | L407W | 1.99 | | | | | | | | |
| 408 | T | Coil | | 107 | T | T | T | T | T | I | Y | | | | | | | | | | | |
| 409 | P | Coil | | 50 | P | P | P | P | T | T | L | | | | | | | | | | | |
| 410 | P | Sheet | | 1 | P | P | P | P | P | Q | E | | | | | | | | | | | |
| 411 | V | Sheet | | 12 | V | V | V | V | V | P | P | | | | | | | | | | | |
| 412 | N | Sheet | | 3 | N | N | N | N | N | P | P | | | | | | | | | | | |
| 413 | G | Sheet | | 0 | G | G | G | G | G | N | I | | | | | | | | | | | |
| 414 | V | Coil | | 0 | V | V | V | V | V | G | H | | | | | | | | | | | |
| 415 | P | Coil | | 6 | P | P | P | P | P | G | G | | | | | | | | | | | |
| 416 | W | Sheet | b7 | 21 | W | W | W | W | W | V | V | | | | | | | | | | | |
| 417 | A | Sheet | | 1 | A | A | A | A | A | P | V | | | | | | | | | | | |
| 418 | R | Sheet | | 42 | R | R | R | R | R | W | T | B21 | R418K | 1.26 | R418T | 1.24 | | | | | | |
| 419 | F | Sheet | | 2 | F | F | F | F | R | V | V | | | | | | | | | | | |
| 420 | N | Sheet | | 17 | N | N | N | N | F | R | R | | | | | | | | | | | |
| 421 | W | Sheet | | 4 | W | W | W | W | N | R | F | | | | | | | | | | | |
| 422 | R | Sheet | | 17 | R | R | R | R | W | F | F | | | | | | | | | | | |
| 423 | N | Sheet | | 18 | N | N | N | N | R | N | N | | | | | | | | | | | |
| 424 | P | Turn | | 23 | P | P | P | P | N | R | R | | | | | | | | | | | |
| 425 | L | Turn | | 96 | L | L | L | L | P | W | R | B21 | L425P | 1.94 | L425G | 1.31 | | | | | | |
| 426 | N | Turn | | 50 | N | N | N | N | L | P | P | | | | | | | | | | | |
| 427 | S | Turn | | 71 | S | S | S | S | N | L | L | B21 | S427Y | 1.44 | | | | | | | | |
| 428 | L | Turn | b8 | 104 | L | L | L | L | S | N | N | | | | | | | | | | | |
| 429 | R | Sheet | | 57 | R | R | R | R | L | S | T | B21 | R429I | 1.36 | | | | | | | | |
| 430 | G | Sheet | | 71 | G | G | G | G | R | G | R | | | | | | | | | | | |
| 431 | S | Sheet | | 56 | S | S | S | S | G | S | G | B21 | S431L | 1.63 | S431H | 1.63 | S431G | 1.42 | S431A | 1.3 | | |
| 432 | L | Sheet | | 42 | L | L | L | L | S | L | T | | | | | | | | | | | |
| 433 | L | Sheet | | 39 | L | L | L | L | A | L | A | | | | | | | | | | | |
| 434 | Y | Sheet | | 4 | Y | Y | Y | Y | T | L | N | | | | | | | | | | | |
| 435 | T | Sheet | | 54 | T | T | T | T | Y | Y | Y | B21 | T435Y | 2.14 | T435H | 1.43 | T435L | 1.21 | | | | |
| 436 | I | Coil | | 21 | I | I | I | I | S | T | S | | | | | | | | | | | |
| 437 | G | Coil | | 75 | G | G | G | G | Q | I | Q | B21 | G437Q | 1.57 | G437N | 1.57 | G437A | 1.43 | G437K | 1.34 | G437R | 1.34 |
| 438 | Y | Coil | | 5 | Y | Y | Y | Y | P | G | P | | G437Q | 1.33 | | | | | | | | |
| 439 | T | Coil | b9 | 60 | T | T | T | T | Q | Y | Y | B21 | T439M | 1.22 | T439Q | 1.21 | | | | | | |
| | | | | | | | | | | | | 258 | T439M | 1.32 | T439D | 1.29 | | | | | | |
| 440 | G | Coil | | 77 | G | G | G | G | G | G | S | | | | | | | | | | | |
| 441 | V | Coil | | 13 | V | V | V | V | V | V | P | | | | | | | | | | | |
| 442 | G | Sheet | | 67 | G | G | G | G | G | G | G | | | | | | | | | | | |
| 443 | T | Sheet | | 37 | T | T | T | T | T | T | L | 258 | T443 Q | 1.36 | | | | | | | | |
| 444 | Q | Sheet | | 39 | Q | Q | Q | Q | Q | Q | Q | | | | | | | | | | | |
| 445 | L | Sheet | | 87 | L | L | L | L | L | L | L | | | | | | | | | | | |
| 446 | F | Sheet | | 31 | F | F | F | F | F | Q | K | | | | | | | | | | | |
| 447 | D | Sheet | | 41 | D | D | D | D | D | D | D | B21 | D447N | 1.55 | D447V | 1.52 | D447I | 1.47 | D447S | 1.34 | D447L | 1.33 |
| | | | | | | | | | | | | | D447A | 1.31 | D447E | 1.3 | D447M | 1.21 | | | | |
| 448 | S | Helix | | 2 | S | S | S | S | S | S | S | | | | | | | | | | | |
| 449 | E | Helix | | 31 | E | E | E | E | E | P | P | | | | | | | | | | | |
| 450 | T | Helix | | 76 | T | T | T | T | T | T | E | | | | | | | | | | | |
| 451 | E | Helix | | 15 | E | E | E | E | E | E | E | | | | | | | | | | | |

TABLE 4-continued

| MP258 position | a.a. | 2D Struc | 2D Assign | Sol. Exp. | MP258 | B21 | B25 | B45 | Bd | Bh | Bi | backbone | Variant | FAE | Variant | FAE | Variant | FAE | Variant | FAE |
|---|---|---|---|---|---|---|---|---|---|---|---|---|---|---|---|---|---|---|---|---|
| 452 | L | Coil | | 2 | L | L | L | L | L | L | L | | | | | | | | | |
| 453 | P | Coil | | 14 | P | P | P | P | P | P | P | | | | | | | | | |
| 454 | P | Coil | | 21 | P | P | P | P | P | P | P | | | | | | | | | |
| 455 | E | Coil | | 38 | E | E | E | E | E | E | E | | | | | | | | | |
| 456 | T | Coil | | 45 | T | T | T | T | T | T | T | | | | | | | | | |
| 457 | T | Coil | | 119 | T | T | T | T | T | T | T | | | | | | | | | |
| 458 | E | Coil | | 95 | E | E | E | E | E | E | E | | | | | | | | | |
| 459 | R | Coil | | 75 | R | R | R | R | R | R | R | | | | | | | | | |
| 460 | P | Coil | | 32 | P | P | P | P | P | P | P | | | | | | | | | |
| 461 | N | Helix | | 34 | N | N | N | N | N | N | N | | | | | | | | | |
| 462 | Y | Helix | | 41 | Y | Y | Y | Y | Y | Y | Y | | | | | | | | | |
| 463 | E | Helix | | 57 | E | E | E | E | E | E | E | | | | | | | | | |
| 464 | S | Helix | | 2 | S | S | S | S | S | S | S | | | | | | | | | |
| 465 | Y | Coil | | 3 | Y | Y | Y | Y | Y | Y | Y | | | | | | | | | |
| 466 | S | Coil | | 0 | S | S | S | S | S | S | S | | | | | | | | | |
| 467 | H | Sheet | b10 | 1 | H | H | H | H | H | H | H | | | | | | | | | |
| 468 | R | Sheet | | 3 | R | R | R | R | R | R | R | | | | | | | | | |
| 469 | L | Sheet | | 13 | L | L | L | L | L | L | L | | | | | | | | | |
| 470 | S | Coil | | 1 | S | S | S | S | S | S | S | | | | | | | | | |
| 471 | N | Sheet | | 2 | N | N | N | N | N | N | N | | | | | | | | | |
| 472 | I | Sheet | | 7 | I | I | I | I | I | I | I | | | | | | | | | |
| 473 | R | Sheet | | 15 | R | R | R | R | G | G | G | B21 | R473T | 12.6 | R473G | 5.48 | R473A | 4.94 | R473S | 3.04 | R473M | 1.94 |
| | | | | | | | | | | | | | R473N | 1.43 | R473K | 1.42 | R473D | 1.39 | R473Y | 1.22 | R473N | 1.43 |
| 474 | L | Sheet | | 1 | L | L | L | L | L | L | L | | | | | | | | | |
| 475 | I | Turn | L3 | 20 | I | I | I | I | I | I | I | | | | | | | | | |
| 476 | S | Coil | | 2 | S | I | I | I | I | S | L | B21 | I476Y | 1.71 | I476H | 1.55 | I476G | 1.48 | I476L | 1.32 | I476S | 1.28 |
| | | | | | | | | | | | | | I476F | 1.25 | I476M | 1.23 | | | | | | |
| 477 | G | Turn | | 126 | G | G | G | G | G | G | Q | B21 | G477S | 2.35 | G477A | 1.29 | | | | | | |
| 478 | N | Turn | | 105 | N | N | N | N | N | S | T | B21 | N478G | 2.96 | N478K | 1.23 | | | | | | |
| 479 | T | Coil | | 31 | T | T | T | T | T | H | R | B21 | T479V | 2.16 | | | | | | | | |
| 480 | L | Coil | | 16 | L | L | L | L | L | V | L | | | | | | | | | |
| 481 | R | Coil | | 22 | R | R | R | R | R | R | N | | | | | | | | | |
| 482 | A | Sheet | b11 | 4 | A | A | A | A | A | A | A | | | | | | | | | |
| 483 | P | Sheet | | 0 | P | P | P | P | P | L | V | | | | | | | | | |
| 484 | V | Sheet | | 3 | V | V | V | V | V | V | V | | | | | | | | | |
| 485 | Y | Sheet | | 1 | Y | Y | Y | Y | Y | Y | Y | | | | | | | | | |
| 486 | S | Sheet | | 0 | S | S | S | S | S | S | S | | | | | | | | | |
| 487 | W | Sheet | | 1 | W | W | W | W | W | W | W | | | | | | | | | |
| 488 | T | Sheet | | 1 | T | T | T | T | T | T | T | | | | | | | | | |
| 489 | H | Sheet | | 8 | H | H | H | H | H | H | H | | | | | | | | | |
| 490 | R | Turn | | 39 | R | R | R | R | R | R | R | 258 | R490Q | 3.53 | | | | | | | | |
| 491 | S | Turn | | 2 | S | S | S | S | S | S | S | | | | | | | | | |
| 492 | A | Coil | | 0 | A | A | A | A | A | A | A | | | | | | | | | |
| 493 | D | Coil | | 30 | D | D | D | D | D | D | D | | | | | | | | | |
| 494 | R | Coil | | 20 | R | R | R | R | R | D | D | | | | | | | | | |
| 495 | T | Coil | | 49 | T | T | T | T | T | T | T | B25 | T495N | 1.54 | | | | | | | | |
| 496 | N | Coil | | 5 | N | N | N | N | N | N | N | | | | | | | | | |
| 497 | T | Sheet | | 60 | T | T | T | T | T | T | T | | | | | | | | | |
| 498 | I | Sheet | | 9 | I | I | I | I | I | I | I | | | | | | | | | |
| 499 | A | Coil | | 68 | A | A | A | A | G | G | G | B25 | A499R | 1.69 | A499S | 1.56 | A499G | 1.52 | A499M | 1.5 | A499C | 1.49 |
| | | | | | | | | | | | | | A499V | 1.42 | A499P | 1.28 | A499W | 1.26 | | | | |

TABLE 4-continued

| MP258 position | a.a. | 2D Struc | 2D Assign | Sol. Exp. | MP258 | B21 | B25 | B45 | Bd | Bh | Bi | backbone | Variant | FAE | Variant | FAE | Variant | FAE | Variant | FAE |
|---|---|---|---|---|---|---|---|---|---|---|---|---|---|---|---|---|---|---|---|---|
| 500 | T | Coil | | 41 | T | T | T | T | P | P | P | | I502K | 2.45 | I502A | 2.26 | I502V | 1.97 | I502T | 1.96 | I502N | 1.83 |
| 501 | N | Coil | | 103 | N | N | N | N | N | N | N | | I502E | 1.83 | I502Q | 1.71 | I502L | 1.71 | I502P | 1.61 | I502H | 1.57 |
| 502 | I | Coil | | 16 | I | I | I | I | R | R | R | | I502R | 1.54 | I502S | 1.48 | I502F | 1.48 | I502Y | 1.42 | | |
| 503 | I | Sheet | b13 | 0 | I | I | I | I | I | I | I | | | | | | | | | | |
| 504 | T | Sheet | | 5 | T | T | T | T | T | T | T | | | | | | | | | | |
| 505 | Q | Sheet | | 8 | Q | Q | Q | Q | Q | Q | Q | | | | | | | | | | |
| 506 | I | Sheet | | 12 | I | I | I | I | I | I | I | | | | | | | | | | |
| 507 | P | Sheet | | 3 | P | P | P | P | P | P | P | | | | | | | | | | |
| 508 | A | Helix | | 0 | A | A | A | A | A | A | A | | | | | | | | | | |
| 509 | V | Helix | | 8 | V | V | V | V | V | V | V | B25 | V509T | 1.26 | | | | | | | | |
| 510 | K | Helix | | 0 | K | K | K | K | K | K | K | | | | | | | | | | |
| 511 | G | Coil | | 0 | G | G | G | G | G | G | G | | | | | | | | | | |
| 512 | N | Coil | | 13 | N | N | N | N | R | R | R | 258 | N512Y | 1.75 | N512M | 1.42 | N512P | 1.71 | N512R | 1.41 | N512K | 1.34 |
| | | | | | | | | | | | | | N512G | 1.31 | N512I | 1.21 | N512Q | 1.26 | N512W | 1.21 | | |
| 513 | F | Sheet | B14 | 47 | F | F | F | F | F | F | F | B25 | F513G | 1.84 | F513P | 1.67 | F513V | 1.71 | F513L | 1.56 | F513H | 1.44 |
| 514 | L | Sheet | | 23 | L | L | L | L | L | L | L | | | | | | | | | | | | |
| 515 | F | Coil | | 29 | F | F | F | F | F | F | F | B25 | F515H | 2.24 | | | | | | | | |
| 516 | N | Coil | | 125 | N | N | N | N | N | N | N | | | | | | | | | | | | |
| 517 | G | Coil | | 13 | G | G | G | G | G | G | G | B25 | G517A | 2.22 | G517S | 1.58 | | | | | | |
| 518 | S | Coil | | 37 | S | S | S | S | S | S | S | B25 | S518D | 3.21 | S518Y | 2.55 | S518A | 2.53 | S518K | 1.44 | S518V | 2.37 |
| | | | | | | | | | | | | | S518L | 2.36 | S518H | 2.26 | S518G | 2.25 | S518E | 2.24 | S518R | 2.18 |
| | | | | | | | | | | | | | S518T | 2.08 | | 1.76 | S518C | | | | | | |
| 519 | V | Sheet | | 7 | V | V | V | V | V | V | V | | | | | | | | | | | | |
| 520 | I | Sheet | | 34 | I | I | I | I | I | I | I | B25 | I520V | 3.39 | I520Y | 2.18 | I520R | 2.08 | I520C | 2.05 | I520K | 1.93 |
| | | | | | | | | | | | | | I502M | 1.74 | I520L | 1.67 | I520E | 1.49 | I520F | 1.34 | I520S | 1.31 |
| | | | | | | | | | | | | | I502A | 1.25 | | | | | | | | | |
| 521 | S | Coil | | 110 | S | S | S | S | S | S | S | B25 | S521G | 2.71 | S521V | 2.52 | S521L | 2.47 | S521A | 2.34 | S521D | 2.09 |
| | | | | | | | | | | | | | S521I | 1.73 | S521F | 1.56 | S521Q | 1.54 | S521P | 1.52 | S521N | 1.44 |
| | | | | | | | | | | | | | S521M | 1.4 | | | | | | | | | |
| 522 | G | Coil | | 2 | G | G | G | G | G | G | G | | | | | | | | | | | | |
| 523 | P | Coil | | 4 | P | P | P | P | P | P | P | | | | | | | | | | | | |
| 524 | G | Coil | | 46 | G | G | G | G | G | G | G | | | | | | | | | | | | |
| 525 | F | Coil | | 11 | F | F | F | F | F | F | F | | | | | | | | | | | | |
| 526 | T | Coil | | 0 | T | T | T | T | T | T | T | B25 | T526L | 1.23 | | | | | | | | |
| 527 | G | Coil | | 13 | G | G | G | G | G | G | G | | | | | | | | | | | | |
| 528 | G | Coil | | 2 | G | G | G | G | G | G | G | | | | | | | | | | | | |
| 529 | D | Coil | | 47 | D | D | D | D | D | D | D | | | | | | | | | | | | |
| 530 | L | Sheet | | 8 | L | L | L | L | L | L | L | | | | | | | | | | | | |
| 531 | V | Sheet | | 2 | V | V | V | V | V | V | V | | | | | | | | | | | | |
| 532 | R | Sheet | b15 | 50 | R | R | R | R | R | R | R | B25 | R532K | 2.58 | R532C | 1.98 | R532W | 1.63 | R532S | 1.59 | R532L | 1.53 |
| | | | | | | | | | | | | | R532V | 1.49 | R532H | 1.37 | R532G | 1.24 | | | | | |
| 533 | L | Sheet | | 6 | L | L | L | L | L | L | L | | | | | | | | | | | | |
| 534 | N | Coil | | 52 | N | N | N | N | N | N | N | B25 | N534S | 2.2 | N534Y | 1.95 | N534Q | 1.9 | N534W | 1.78 | N534E | 1.58 |
| | | | | | | | | | | | | | N534H | 1.51 | N534D | 1.49 | N534L | 1.48 | | | | | |
| 535 | N | Coil | | 62 | N | N | N | N | N | R | N | B25 | N535M | 2.96 | N535R | 2.26 | N535E | 1.88 | N535F | 1.68 | N535K | 1.68 |
| | | | | | | | | | | | | | N535L | 1.48 | N535D | 1.48 | N535Q | 1.43 | N535S | 1.29 | N535I | 1.23 |
| | | | | | | | | | | | | | N535D | 1.21 | | | | | | | | | |
| 536 | S | Coil | | 50 | S | S | S | S | S | S | S | | | | | | | | | | | | |

TABLE 4-continued

| MP258 position | a.a. | 2D Struc | 2D Assign | Sol. Exp. | MP258 | B21 | B25 | B45 | Bd | Bh | Bi | backbone | Variant | FAE | Variant | FAE | Variant | FAE | Variant | FAE |
|---|---|---|---|---|---|---|---|---|---|---|---|---|---|---|---|---|---|---|---|---|
| 537 | G | Sheet | | 92 | G | G | G | G | G | G | G | 258 | G537W | 2.23 | G537E | 2.02 | G537F | 1.9 | G537A | 1.77 | G537K | 1.69 |
| | | | | | | | | | | | | | G537S | 1.48 | G537Q | 1.48 | G537Y | 1.43 | G537R | 1.4 | G537D | 1.33 |
| | | | | | | | | | | | | | G537V | 1.33 | G537N | 1.3 | G537H | 1.3 | G537T | 1.25 | | |
| 538 | N | Sheet | | 72 | N | N | N | N | N | N | N | 258 | N538T | 2.22 | N538T | 2 | N538S | 1.95 | N538V | 1.57 | N538W | 1.5 |
| | | | | | | | | | | | | | N538V | 1.47 | N538G | 1.43 | N538Q | 1.42 | N538I | 1.41 | N538D | 1.32 |
| | | | | | | | | | | | | | N538W | 1.57 | N538L | 1.5 | N538L | 1.47 | N538Q | 1.42 | N538I | 1.4 |
| | | | | | | | | | | | | | N538E | 1.3 | N538P | 1.25 | N538M | 1.23 | | 1.2 | | |
| 539 | N | Coil | | 4 | N | N | N | N | N | N | N | | | | | | | | | | | |
| 540 | I | Sheet | b16 | 2 | I | I | I | I | I | I | I | | | | | | | | | | | |
| 541 | Q | Sheet | | 50 | Q | Q | Q | Q | Q | Q | Q | 258 | Q541Y | 2.58 | Q541W | 1.35 | Q541F | 1.27 | | | | |
| 542 | N | Sheet | | 23 | N | N | N | N | N | N | N | | | | | | | | | | | |
| 543 | R | Sheet | | 35 | R | R | R | R | R | R | R | | | | | | | | | | | |
| 544 | G | Sheet | | 38 | G | G | G | G | G | G | G | | | | | | | | | | | |
| 545 | Y | Sheet | | 37 | Y | Y | Y | Y | Y | Y | Y | 258 | Y545F | 1.3 | | | | | | | | |
| 546 | L | Sheet | | 8 | L | L | L | L | L | L | L | | | | | | | | | | | |
| 547 | E | Coil | | 101 | E | E | E | E | E | E | E | 258 | E547A | 1.88 | E547S | 1.82 | E547G | 1.72 | E547I | 1.25 | E547M | 1.24 |
| | | | | | | | | | | | | | E547Q | 1.21 | | | | | | | | |
| 548 | V | Coil | | 4 | V | V | V | V | V | V | V | | | | | | | | | | | |
| 549 | P | Coil | | 50 | P | P | P | P | P | P | P | | | | | | | | | | | |
| 550 | I | Coil | | 7 | I | I | I | I | I | I | I | | | | | | | | | | | |
| 551 | Q | Coil | | 90 | Q | Q | Q | Q | Q | Q | Q | B25 | Q551C | 2.51 | Q551R | 2.17 | Q551A | 1.98 | Q551S | 1.76 | Q551D | 1.54 |
| | | | | | | | | | | | | | Q551Y | 1.34 | | | | | | | | |
| 552 | F | Coil | | 103 | F | F | F | F | F | F | F | B25 | F552T | 1.72 | F552V | 1.69 | F552W | 1.57 | | | | |
| 553 | I | Coil | | 75 | I | I | I | I | I | I | I | B25 | I553Q | 2.41 | I553D | 2.15 | I553G | 1.96 | I553A | 1.83 | I553W | 1.78 |
| | | | | | | | | | | | | | I553F | 1.71 | I553L | 1.69 | I553P | 1.65 | I553E | 1.5 | I553L | 1.49 |
| | | | | | | | | | | | | | I553S | 1.49 | I553T | 1.47 | | | | | | |
| 554 | S | Coil | | 120 | S | S | S | S | S | S | S | B25 | S554K | 1.87 | S554R | 1.56 | S554D | 1.45 | S554H | 1.43 | S554N | 1.25 |
| | | | | | | | | | | | | | S554G | 1.22 | | | | | | | | |
| 555 | T | Coil | | 79 | T | T | T | T | T | T | T | B25 | T555V | 2.13 | T555M | 1.64 | T555I | 1.32 | T555W | 1.3 | | |
| 556 | S | Coil | | 24 | S | S | S | S | S | S | S | B25 | S556A | 2.65 | S556W | 2.25 | S556G | 2.05 | S556D | 1.6 | S556C | 1.41 |
| | | | | | | | | | | | | | S556P | 1.27 | | | | | | | | |
| 557 | T | Coil | | 21 | T | T | T | T | T | T | T | B25 | T557I | 1.75 | T557R | 1.61 | T557G | 1.55 | T557S | 1.39 | T557Q | 1.38 |
| | | | | | | | | | | | | | T557M | 1.31 | T557V | 1.28 | T557A | 1.27 | T557C | 1.26 | | |
| 558 | R | Sheet | B17 | 65 | R | R | R | R | R | R | R | B25 | R558V | 2.16 | R558T | 1.95 | R558T | 1.83 | R558L | 1.83 | R558W | 1.79 |
| | | | | | | | | | | | | | R558G | 1.75 | R558S | 1.59 | R558A | 1.53 | R558I | 1.5 | R558D | 1.4 |
| | | | | | | | | | | | | | R558F | 1.37 | R558P | 1.27 | R558M | 1.26 | | | R558H | 1.22 |
| | | | | | | | | | | | | | Y559W | 1.26 | | | | | | | | |
| 559 | Y | Sheet | | 1 | Y | Y | Y | Y | Y | Y | Y | | | | | | | | | | | |
| 560 | R | Sheet | | 38 | R | R | R | R | R | R | R | | | | | | | | | | | |
| 561 | V | Sheet | | 7 | V | V | V | V | V | V | V | | | | | | | | | | | |
| 562 | R | Sheet | | 21 | R | R | R | R | R | R | R | | | | | | | | | | | |
| 563 | V | Sheet | | 5 | V | V | V | V | V | V | V | B25 | V563N | 4.65 | V563L | 2.56 | V563E | 2.1 | V563A | 1.39 | | |
| 564 | R | Sheet | | 7 | R | R | R | R | R | R | R | B25 | R564H | 4.11 | R564V | 3.28 | R564W | 3.03 | R564I | 3.02 | R564K | 2.71 |
| | | | | | | | | | | | | | R564C | 1.79 | R564S | 1.42 | R564A | 1.36 | | | | |
| 565 | Y | Sheet | | 5 | Y | Y | Y | Y | Y | Y | Y | B25 | Y565F | 3.4 | | | | | | | | |
| 566 | A | Sheet | | 55 | A | A | A | A | A | A | A | | | | | | | | | | | |
| 567 | S | Sheet | | 2 | S | S | S | S | S | S | S | | | | | | | | | | | |
| 568 | V | Coil | | 29 | V | V | V | V | V | V | V | B25 | V568C | 2.44 | V568E | 2.31 | V568A | 1.81 | V568F | 1.8 | V568R | 1.65 |
| | | | | | | | | | | | | | V568G | 1.54 | V568L | 1.52 | V568S | 1.5 | V568W | 1.39 | V568N | 1.31 |
| 569 | T | Coil | | 33 | T | T | T | T | T | T | T | B25 | T569I | 1.75 | T569L | 1.67 | T569M | 1.29 | T569S | 1.2 | | |
| 570 | P | Coil | | 69 | P | P | P | P | P | P | P | 258 | P570M | 2.08 | P570F | 1.6 | P570W | 1.45 | P570T | 1.38 | | |
| 571 | I | Sheet | b18 | 4 | I | I | I | I | I | I | I | B25 | I571G | 4.18 | I571V | 3.13 | I571T | 3.07 | I571C | 2.72 | I571 | 2.2 |

TABLE 4-continued

| MP258 position | a.a. | 2D Struc | 2D Assign | Sol. Exp. | MP258 | B21 | B25 | B45 | Bd | Bh | Bi | backbone | Variant | FAE | Variant | FAE | Variant | FAE | Variant | FAE |
|---|---|---|---|---|---|---|---|---|---|---|---|---|---|---|---|---|---|---|---|---|
| 572 | Q | Sheet | | 32 | Q | Q | R | R | E | E | H | 258 | Q572H | 2.51 | Q572P | 2.29 | Q572R | 2.03 | Q572I | 1.96 | Q572 | 1.69 |
| | | | | | | | | | | | | | Q572F | 1.65 | Q572S | 1.54 | Q572A | 1.38 | Q572V | 1.35 | Q572 | 1.3 |
| | | | | | | | | | | | | | Q572M | 1.28 | | | | | | | | |
| 573 | L | Sheet | | 7 | L | L | L | L | L | L | L | B25 | L573A | 3.14 | L573T | 3.09 | L573G | 2.12 | | | | |
| 574 | S | Sheet | | 21 | S | S | S | S | S | S | S | 258 | S574R | 1.22 | | | | | | | | |
| 575 | V | Sheet | | 11 | V | V | V | V | V | V | V | | | | | | | | | | | |
| 576 | N | Sheet | | 26 | N | N | N | N | N | N | N | | | | | | | | | | | |
| 577 | W | Sheet | | 6 | W | W | W | W | L | W | W | 258 | W577R | 3.24 | W577F | 2.01 | W577K | 1.74 | W577M | 1.72 | W577V | 1.63 |
| | | | | | | | | | | | | | W577A | 1.56 | W577T | 1.47 | W577H | 1.33 | W577G | 1.28 | W577I | 1.24 |
| 578 | G | Turn | | 109 | G | G | G | G | G | G | G | | | | | | | | | | | |
| 579 | N | Turn | | 120 | N | N | N | N | N | N | N | | | | | | | | | | | |
| 580 | S | Coil | | 66 | S | S | S | S | S | S | S | | | | | | | | | | | |
| 581 | N | Coil | | 85 | N | N | N | N | N | N | N | 258 | N581S | 1.83 | N581K | 1.57 | | | | | | |
| 582 | I | Coil | | 14 | I | I | I | I | I | I | I | B25 | I582V | 1.69 | | | | | | | | |
| 583 | F | Sheet | | 3 | F | F | F | F | F | F | F | B25 | F583S | 2.8 | | | | | | | | |
| 584 | S | Sheet | b19 | 71 | S | S | S | S | S | S | S | B21 | S584R | 1.21 | | | | | | | | |
| 585 | S | Sheet | | 33 | S | S | S | S | S | S | S | 258 | S585R | 3.33 | S585T | 2.53 | S585H | 2.17 | S585Q | 2.14 | S585Q | 2.04 |
| | | | | | | | | | | | | | S585L | 1.86 | S585W | 1.69 | S585M | 1.59 | S585N | 1.3 | S585F | 1.3 |
| | | | | | | | | | | | | | S585I | 1.27 | | | | | | | | | |
| 586 | I | Sheet | | 73 | I | I | I | I | T | T | T | 258 | I586M | 4.11 | I586Y | 2.77 | I586P | 2.19 | I586A | 1.97 | I586S | 1.84 |
| | | | | | | | | | | | | | I586K | 1.83 | I586R | 1.77 | I586R | 1.73 | I586F | 1.65 | I586 | 1.6 |
| | | | | | | | | | | | | | I586Q | 1.48 | I586N | 1.41 | I586L | 1.35 | I586W | 1.32 | I586T | 1.26 |
| 587 | V | Sheet | | 17 | V | V | V | V | L | L | V | 258 | V587H | 2.82 | V587C | 2.28 | V587N | 1.97 | V587S | 1.85 | V587D | 1.76 |
| | | | | | | | | | | | | | V587R | 1.7 | V587A | 1.7 | V587T | 1.65 | V587K | 1.57 | V587E | 1.43 |
| | | | | | | | | | | | | | V587W | 1.4 | V587L | 1.4 | V587Y | 1.37 | V587F | 1.4 | | |
| 588 | P | Coil | | 77 | P | P | P | P | P | P | P | B25 | T590A | 1.8 | T590D | 1.56 | T590A | 1.54 | T590S | 1.3 | T590G | 1.26 |
| 589 | A | Coil | | 38 | A | A | A | A | A | A | A | 258 | A591H | 2.82 | A591V | 2.28 | A591H | 1.97 | A591T | 1.85 | A591D | 1.76 |
| 590 | T | Coil | | 6 | T | T | T | T | T | T | T | | A591R | 1.7 | A591S | 1.7 | A591R | 1.65 | A591C | 1.65 | A591E | 1.43 |
| 591 | A | Coil | | 42 | A | A | A | A | A | A | A | | A591W | 1.4 | A591L | 1.4 | A591L | 1.4 | A591F | 1.37 | A591P | 1.26 |
| | | | | | | | | | | | | | A591Q | 1.2 | | | | | | | | | |
| 592 | T | Coil | | 87 | T | T | T | T | A | A | A | 258 | T592Q | 2.9 | T592M | 2.39 | T592A | 2.02 | T592Y | 1.82 | T592N | 1.8 |
| | | | | | | | | | | | | | T592K | 1.78 | T592K | 1.7 | T592D | 1.63 | T592D | 1.57 | T592I | 1.41 |
| | | | | | | | | | | | | | T592G | 1.33 | T592F | 1.23 | T592V | 1.21 | T592W | 1.21 | | |
| 593 | S | Turn | | 102 | S | S | S | S | S | S | S | B21 | S593Y | 1.66 | S593G | 1.44 | S593R | 1.24 | S593V | 1.24 | | |
| 594 | L | Turn | | 130 | L | L | L | L | L | L | L | | | | | | | | | | | |
| 595 | D | Coil | | 63 | D | D | D | D | D | D | D | B21 | D595R | 1.83 | D595S | 1.77 | D595G | 1.74 | D595T | 1.5 | D595N | 1.57 |
| | | | | | | | | | | | | | D595V | 1.55 | D595F | 1.54 | D595K | 1.52 | D595P | 1.21 | D595Y | 1.4 |
| | | | | | | | | | | | | | D595I | 1.36 | D595M | 1.3 | D595A | 1.25 | | | | |
| 596 | N | Coil | | 100 | N | N | N | N | N | N | N | B21 | N596T | 2.7 | N596R | 2.45 | N596I | 2.15 | N596S | 2.14 | N596N | 1.97 |
| | | | | | | | | | | | | | N596L | 1.7 | N596W | 1.54 | N596Y | 1.33 | N596H | 1.3 | N596Y | 1.3 |
| | | | | | | | | | | | | | N596D | 1.29 | | | | | | | | | |
| 597 | L | Coil | | 64 | L | L | L | L | L | L | L | B21 | Q598V | 1.5 | Q598G | 1.27 | Q598D | 1.21 | Q598I | 1.21 | | |
| 598 | Q | Coil | | 57 | Q | Q | Q | Q | Q | Q | Q | B25 | S599C | 1.72 | S599Q | 1.72 | S599L | 1.6 | S599Y | 1.48 | S599T | 1.47 |
| 599 | S | Coil | | 35 | S | S | S | S | S | S | S | | S599V | 1.44 | S599A | 1.27 | S599P | 1.24 | | | | |
| 600 | R | Coil | | 58 | R | R | R | R | R | R | R | | | | | | | | | | | |
| 601 | D | Sheet | b20 | 20 | D | D | D | D | D | D | D | B21 | N601Y | 1.47 | N601F | 1.33 | N601V | 1.33 | N601G | 1.25 | N601M | 1.24 |
| | | | | | | | | | | | | | N601E | 1.22 | | | | | | | | | |
| 602 | F | Sheet | | 55 | F | F | F | F | F | F | F | B25 | F602M | 2.53 | | | | | | | | |

TABLE 4-continued

| MP258 position | a.a. | 2D Struc | 2D Assign | Sol. Exp. | MP258 | B21 | B25 | B45 | Bd | Bh | Bi | backbone | Variant | FAE | Variant | FAE | Variant | FAE | Variant | FAE |
|---|---|---|---|---|---|---|---|---|---|---|---|---|---|---|---|---|---|---|---|---|
| 603 | G | Sheet | | 27 | G | G | G | G | G | G | G | B25 | G603M | 2.12 | G603A | 2.04 | G603Y | 2.04 | G603R | 1.88 | G603S | 1.75 |
| | | | | | | | | | | | | | G603L | 1.57 | G603W | 1.46 | G603D | 1.3 | G603T | 1.23 | | |
| 604 | Y | Coil | | 4 | Y | Y | Y | Y | Y | Y | Y | | | | | | | | | | | |
| 605 | F | Coil | | 108 | F | F | F | F | V | V | F | 258 | F605S | 2.2 | F605W | 1.91 | F605R | 1.89 | F605M | 1.85 | F605A | 1.63 |
| | | | | | | | | | | | | | F605I | 1.56 | F605C | 1.52 | F605Y | 1.45 | F605K | 1.45 | F605I | 1.56 |
| | | | | | | | | | | | | | F605D | 1.39 | F605Y | 1.38 | F605N | 1.38 | F605Q | 1.35 | F605G | 1.34 |
| | | | | | | | | | | | | | F605E | 1.27 | F605P | 1.25 | | | | | | |
| 606 | E | Coil | | 86 | E | E | E | E | E | E | E | B21 | E606R | 3.03 | E606H | 2.38 | E606K | 2.27 | E606F | 2.19 | E606Q | 2.12 |
| | | | | | | | | | | | | | E606W | 1.83 | E606Y | 1.76 | E606Y | 1.78 | E606M | 1.74 | E606T | 1.64 |
| | | | | | | | | | | | | | E606A | 1.51 | E606I | 1.37 | E606L | 1.34 | E606N | 1.28 | | |
| 607 | S | Coil | | 9 | S | S | S | S | I | I | S | 258 | S607R | 2.59 | S607C | 1.58 | S607T | 1.58 | S607I | 1.55 | S607Q | 1.48 |
| | | | | | | | | | | | | | S607G | 1.34 | S607D | 1.31 | S607E | 1.27 | S607V | 1.26 | | |
| 608 | T | Sheet | | 14 | T | T | R | R | N | N | T | 258 | T608R | 2.35 | T608Y | 2.2 | T608S | 2.24 | T608V | 1.88 | T608F | 1.7 |
| | | | | | | | | | | | | | T608G | 1.5 | | | T608L | 1.47 | T608K | 1.32 | T608W | 1.23 |
| 609 | N | Sheet | | 40 | N | N | N | N | N | N | N | B25 | N609P | 2.52 | N609G | 2.4 | N609R | 2.23 | N609S | 2.2 | N609S | 1.93 |
| | | | | | | | | | | | | | N609V | 1.91 | N609F | 1.46 | N609I | 1.31 | | | | |
| 610 | A | Coil | | 0 | A | A | A | A | A | A | A | B25 | A610F | 2.13 | A610G | 1.45 | A610P | 1.29 | A610L | 1.28 | | |
| 611 | F | Coil | | 90 | F | F | F | F | F | F | F | B25 | F611L | 2.19 | F611K | 1.58 | F611G | 1.48 | F611W | 1.44 | F611V | 1.38 |
| 612 | T | Coil | | 73 | T | T | T | T | T | T | T | B25 | T612F | 2.32 | T612H | 2.07 | T612G | 1.36 | T612E | 1.35 | T612N | 1.31 |
| | | | | | | | | | | | | | T612D | 1.23 | T612P | 1.21 | | | | | | |
| 613 | S | Coil | | 89 | S | S | S | S | S | S | S | B25 | S613R | 2.85 | S613T | 1.98 | S613G | 1.58 | S613V | 1.54 | S613N | 1.5 |
| | | | | | | | | | | | | | S613Y | 1.47 | | | | | | | | |
| 614 | A | Sheet | b22 | 51 | A | A | A | A | A | A | A | B25 | A614M | 2.07 | A614S | 2.01 | A614L | 1.73 | A614H | 1.66 | A614V | 1.66 |
| | | | | | | | | | | | | | A614R | 1.64 | A614G | 1.55 | A614Y | 1.35 | A614D | 1.2 | A614R | 1.64 |
| 615 | T | Sheet | | 14 | T | T | T | T | T | T | T | | | | | | | | | | | | |
| 616 | G | Sheet | | 50 | G | G | G | G | G | G | G | | | | | | | | | | | | |
| 617 | N | Sheet | | 31 | N | N | N | N | N | N | N | B25 | N617V | 2.25 | N617Q | 1.96 | N617K | 1.96 | N617M | 1.76 | N617M | 1.57 |
| | | | | | | | | | | | | | N617R | 1.56 | N617C | 1.25 | N617L | 1.23 | | | | |
| 618 | V | Sheet | | 17 | V | V | V | V | V | I | V | 258 | V618L | 1.82 | V618D | 1.51 | V618N | 1.48 | V618R | 1.4 | V618G | 1.31 |
| | | | | | | | | | | | | | V618L | 1.3 | | | V618T | 1.29 | V618W | 1.24 | | |
| 619 | V | Sheet | | 10 | V | V | V | V | V | V | V | | | | | | | | | | | | |
| 620 | G | Sheet | | 2 | G | G | G | G | G | G | G | | | | | | | | | | | | |
| 621 | V | Sheet | | 4 | V | V | V | A | V | V | V | | | | | | | | | | | | |
| 622 | R | Coil | | 61 | R | R | R | R | R | R | R | | | | | | | | | | | | |
| 623 | N | Coil | | 89 | N | N | N | N | N | N | N | | | | | | | | | | | | |
| 624 | F | Coil | | 0 | F | F | F | F | F | F | F | | F624A | 1.27 | F624M | | | | | | | |
| 625 | S | Coil | | 123 | S | S | S | S | S | S | S | | | | | | | | | | | | |
| 626 | E | Coil | | 83 | E | E | E | E | A | A | E | 258 | E626K | 3.16 | E626G | 2.62 | E626T | 2.01 | E626H | 1.84 | E626H | 1.81 |
| | | | | | | | | | | | | | E626A | 1.71 | E626N | 1.45 | E626Y | 1.44 | E626Q | 1.43 | E626Q | 1.37 |
| | | | | | | | | | | | | | E626P | 1.31 | E626S | 1.29 | | | | | | |
| 627 | N | Coil | | 98 | N | N | N | N | N | N | N | | | | | | | | | | | | |
| 628 | A | Coil | | 19 | A | A | A | A | A | A | A | B25 | A628V | 2.38 | A628F | 2.05 | A628Q | 1.86 | A628W | 1.81 | A628W | 1.62 |
| | | | | | | | | | | | | | A628S | 1.59 | A628R | 1.49 | A628G | 1.49 | A628L | 1.42 | A628I | 1.21 |
| | | | | | | | | | | | | | A628D | 1.21 | | | | | | | | |
| 629 | G | Coil | | 42 | G | G | G | G | E | E | R | 258 | G629M | 1.57 | G629Q | 1.42 | G629R | 1.4 | G629P | 1.36 | G629A | 1.32 |
| | | | | | | | | | | | | | G629S | 1.28 | G629T | 1.28 | G629E | 1.23 | | | | |
| 630 | V | Sheet | b23 | 2 | V | V | V | V | V | V | V | B25 | V630A | 1.9 | V630C | 1.62 | | | | | | |
| 631 | I | Sheet | | 12 | I | I | I | I | I | I | I | | | | | | | | | | | | |
| 632 | I | Sheet | | 8 | I | I | I | I | I | I | I | | | | | | | | | | | | |
| 633 | D | Coil | | 4 | D | D | D | D | D | D | D | | | | | | | | | | | | |

TABLE 4-continued

| MP258 position | a.a. | 2D Struc | 2D Assign | Sol. Exp. | MP258 | B21 | B25 | B45 | Bd | Bh | Bi | backbone | Variant | FAE | Variant | FAE | Variant | FAE | Variant | FAE | Variant | FAE |
|---|---|---|---|---|---|---|---|---|---|---|---|---|---|---|---|---|---|---|---|---|---|---|
| 634 | R | Sheet | | 7 | R | R | R | R | R | R | R | | | | | | | | | | | |
| 635 | F | Sheet | | 23 | F | F | F | F | F | F | F | | | | | | | | | | | |
| 636 | E | Sheet | | 0 | E | E | E | E | E | E | E | | | | | | | | | | | |
| 637 | F | Sheet | | 15 | F | F | F | F | F | F | F | | | | | | | | | | | |
| 638 | I | Sheet | | 12 | I | I | I | I | I | I | I | | | | | | | | | | | |
| 639 | P | Sheet | | 6 | P | P | P | P | P | P | P | | | | | | | | | | | |
| 640 | V | Turn | | 33 | V | V | V | V | V | V | V | | | | | | | | | | | |
| 641 | T | Turn | | 113 | T | T | T | T | T | T | T | B25 | T641P | 3.01 | T641H | 2.65 | T641A | 2.45 | T641L | 2.43 | T641Q | 2.31 |
| | | | | | | | | | | | | | T641Y | 2.21 | T641E | 2.1 | T641I | 1.96 | T641S | 1.91 | T641V | 1.82 |
| | | | | | | | | | | | | | T641D | 1.57 | T641G | 1.21 | | | | | | |
| 642 | A | Coil | | 3 | A | A | A | A | A | A | A | | | | | | | | | | | |
| 643 | T | Coil | | 117 | T | T | T | T | T | T | T | B25 | T643L | 2.72 | T643A | 2.09 | T643Q | 1.94 | T643H | 2.04 | T643S | 1.58 |
| | | | | | | | | | | | | | T643D | 1.53 | T643M | 1.51 | T643C | 1.26 | T643R | 1.38 | | |
| 644 | F | | | | F | F | F | F | F | F | F | | | | | | | | | | | |
| 645 | E | | | | E | E | E | E | E | E | E | B25 | E645T | 2.28 | E645M | 2.26 | E645L | 1.8 | E645Y | 1.77 | E645A | 1.73 |
| | | | | | | | | | | | | | E645N | 1.71 | E645V | 1.67 | E645P | 1.65 | E645I | 1.61 | E645W | 1.48 |
| | | | | | | | | | | | | | E645C | 1.28 | E645S | 1.21 | | | | | | |
| 646 | A | | | | A | A | A | A | A | A | A | B25 | A646S | 1.96 | A646Y | 1.95 | A646D | 1.78 | A646E | 1.65 | A646M | 1.57 |
| | | | | | | | | | | | | | A646F | 1.51 | A646H | 1.46 | A646V | 1.41 | A646W | 1.37 | A646I | 1.37 |
| | | | | | | | | | | | | | A646C | 1.27 | | | | | | | | |
| 647 | E | | | | E | E | E | E | E | K | E | | | | | | | | | | | |
| 648 | Y | | | | Y | Y | Y | Y | Y | Y | Y | | | | | | | | | | | |
| 649 | D | | | | D | D | D | D | D | D | D | | | | | | | | | | | |
| 650 | L | | | | L | L | L | L | L | L | L | | | | | | | | | | | |
| 651 | E | | | | E | E | E | E | E | E | E | | | | | | | | | | | |

TABLE 5

| MP258 position | MP258 a.a. | Backbone | Variant | FAE | Variant | FAE | Variant | FAE | Variant |
|---|---|---|---|---|---|---|---|---|---|
| 50 | L | B45 | L50W | 1.06 | L50M | 1.05 | L50E | 0.98 | L50T |
| 53 | A | B45 | A53N | 1.19 | A53I | 1.15 | A53W | 1.13 | A53L |
| 54 | S | B45 | S54M | 1.16 | S54Y | 1.13 | S54H | 1.11 | S54L |
|  |  |  | S54D | 0.87 | S54W | 0.57 |  |  |  |
| 57 | Q | B45 | Q57C | 1.19 | Q57E | 1.14 | Q57S | 1.13 | Q57W |
| 65 | R | B45 | R65M | 1.19 | R65T | 1.15 | R65K | 1.04 | R65L |
|  |  |  | R65W | 0.50 |  |  |  |  |  |
| 67 | L | B45 | L67P | 1.12 | 467Q | 1.11 | L67W | 0.54 | L67A |
|  |  |  | L67S | 0.49 | L67C | 0.48 | L67D | 0.48 | L67V |
| 68 | G | B45 | G68D | 1.16 | G68K | 1.08 | G68M | 0.75 | G68L |
|  |  |  | G68P | 0.48 | G68W | 0.37 |  |  |  |
| 70 | L | B45 | L70S | 1.16 | L70T | 1.11 | L70Q | 1.10 | L70A |
|  |  |  | L70Y | 0.92 | L70V | 0.92 | L70P | 0.90 | L70R |
| 71 | G | B45 | G71D | 1.12 | G71E | 1.11 | G71F | 1.10 | G71N |
|  |  |  | G71Q | 0.79 | G71C | 0.75 | G71V | 0.72 | G71L |
| 72 | V | B45 | V72S | 0.85 | V72R | 0.84 | V72L | 0.81 | V72F |
|  |  |  | V72A | 0.66 | V72W | 0.64 | V72C | 0.64 | V72K |
| 73 | P | B45 | P73F | 1.14 | P73R | 1.11 | P73W | 0.80 | P73A |
| 74 | F | B45 | F74N | 1.19 | F74T | 1.15 | F74W | 1.04 | F74L |
|  |  |  | F74C | 0.78 | F74M | 0.37 |  |  |  |
| 75 | A | B45 | A75D | 1.03 | A75F | 0.94 | A75R | 0.90 | A75V |
| 76 | G | B45 | G76K | 1.15 | G76W | 0.94 | G76Y | 0.91 | G76H |
| 77 | Q | B45 | Q77V | 1.15 | Q77F | 1.13 | Q77Y | 1.08 | Q77R |
| 79 | A | B45 | A79E | 0.98 | A79G | 0.71 | A79F | 0.57 |  |
| 80 | S | B45 | S80I | 1.20 | S80T | 0.54 |  |  |  |
| 83 | S | B45 | S83T | 1.19 | S83V | 0.60 | S83I | 0.60 | S83P |
| 87 | G | B45 | G87Y | 1.10 | G87S | 1.05 | G87F | 1.01 | G87L |
| 91 | P | B45 | P91I | 1.17 | P91Q | 1.14 | P91W | 1.13 | P91G |
|  |  |  | P91K | 0.54 | P91C | 0.53 | P91H | 0.53 | P91A |
| 92 | S | B45 | S92K | 1.03 | S92W | 0.85 | S92R | 0.76 | S92M |
| 93 | G | B45 | G93E | 0.93 | G93N | 0.90 | G93V | 0.86 | G93L |
|  |  |  | G93W | 0.74 | G93C | 0.72 | G93R | 0.69 | G93Y |
| 94 | R | B45 | R94E | 0.99 | R94K | 0.95 | R94V | 0.95 | R94G |
|  |  |  | R94M | 0.70 |  |  |  |  |  |
| 95 | D | B45 | D95W | 1.10 | D95T | 0.94 | D95L | 0.87 | D95R |
| 106 | Q | B45 | Q106P | 1.08 | Q106L | 1.08 | Q106N | 0.98 | Q106Y |
| 108 | V | B45 | V108G | 1.14 | V108K | 1.14 | V108S | 1.06 | V108C |
| 109 | R | 258 | R109K | 1.07 | R109A | 1.05 | R109Q | 1.02 | R109W |
|  |  |  | R109T | 0.85 | R109D | 0.84 | R109F |  |  |
| 110 | Q | 258 | Q110K | 1.19 | Q110D | 1.18 | Q110I | 1.18 | Q110M |
|  |  |  | Q110C | 0.84 | Q110A | 0.77 | Q110W | 0.73 | Q110G |
| 111 | Q | 258 | Q111V | 1.14 | Q111W | 1.08 | Q111N | 1.01 | Q111F |
|  |  |  | Q111D | 0.25 |  |  |  |  |  |
| 112 | I | B45 | I112K | 0.93 | I112G | 0.84 | I112M | 0.64 | I112C |
|  |  |  | I112S | 0.27 | I112F | 0.27 | I112D | 0.26 | I112R |
| 113 | T | B45 | T113W | 0.98 | T113F | 0.82 | T113C | 0.75 | T113P |
| 114 | E | 258 | E114Q | 1.15 | E114W | 1.04 | E114C | 0.79 | E114R |
| 115 | N | B45 | N115I | 0.96 | N115Y | 0.93 | N115M | 0.91 | N115S |
|  |  |  | N115W | 0.57 | N115K | 0.51 | N115R | 0.35 | N115H |
| 118 | N | B45 | N118W | 1.05 | N118K | 0.99 | N118Y | 0.92 | N118R |
| 119 | T | B45 | T119Y | 1.00 | T119F | 0.99 | T119P | 0.83 | T119W |
| 122 | A | B45 | A122E | 1.11 | A122L | 1.06 | A122S | 1.06 | A122W |
| 123 | R | B45 | R123H | 0.73 | R123A | 0.73 | R123Y | 0.72 | R123P |
|  |  |  | R123G | 0.55 | R123N | 0.49 | R123S | 0.49 | R123M |
|  |  |  | R123I | 0.24 |  |  |  |  |  |
| 125 | Q | B45 | Q125V | 1.14 | Q125I | 0.96 | Q125K | 0.63 |  |
| 129 | A | B45 | A129E | 1.08 | A129Y | 1.08 | A129R | 1.07 | A129Q |
|  |  |  | A129F | 0.83 | A129I | 0.83 |  |  |  |
| 132 | R | B45 | R132Y | 0.98 | R132A | 0.96 | R132V | 0.96 | R132M |
|  |  |  | R132F | 0.68 | R132D | 0.66 | R132G | 0.65 | R132N |
| 133 | A | B45 | A133D | 0.87 | A133V | 0.85 | A133S | 0.63 | A133T |
|  |  |  | A133Q | 0.32 | A133F | 0.32 | A133E | 0.29 | A133L |
| 136 | Q | B45 | Q136G | 1.06 | Q136W | 1.03 | Q136D | 0.96 | Q136S |
| 140 | D | B45 | D140G | 0.92 | D140Y | 0.73 | D140S | 0.46 | D140T |
|  |  |  | D140R | 0.24 | D140A | 0.22 | D140L | 0.22 |  |
| 142 | L | B45 | L142H | 1.03 | L142Q | 0.86 | L142S | 0.78 | L142R |
|  |  |  | L142W | 0.58 | L142D | 0.52 | L142C | 0.47 | L142E |
| 143 | E | B45 | E143K | 0.98 | E143D | 0.98 | E143V | 0.95 |  |
| 144 | N | B45 | N144F | 1.13 | N144P | 1.09 | N144S | 1.07 | N144Y |
| 145 | R | B45 | R145F | 1.16 | R145Q | 1.02 | R145V | 0.99 | R145T |
| 146 | D | B45 | D146E | 1.16 | D146A | 1.15 | D146P | 1.14 | D146S |
|  |  |  | D146F | 0.95 | D146G | 0.83 | D146M | 0.80 |  |
| 147 | D | B45 | N147T | 1.02 | N147L | 1.01 | N147Y | 0.63 | N147K |
|  |  |  | N147Q | 0.49 | N147G | 0.45 |  |  |  |
| 148 | A | B45 | A148G | 1.18 | A148Q | 1.00 | A148M | 0.95 | A148R |
|  |  |  | A148E | 0.76 |  |  |  |  |  |
| 149 | R | B45 | R149F | 1.00 | R149Q | 0.99 | R149H | 0.94 | R149W |

TABLE 5-continued

| | | | | | | | | | |
|---|---|---|---|---|---|---|---|---|---|
| 151 | R | B45 | R151S | 1.06 | R151V | 0.90 | R151K | 0.72 | R151M |
| | | | R151A | 0.50 | R151I | 0.42 | R151N | 0.42 | R151Y |
| | | | R151F | 0.27 | | | | | |
| 152 | S | B45 | S152K | 1.07 | S152M | 0.98 | S152C | 0.95 | S152Q |
| | | | S152P | 0.47 | S152Y | 0.44 | S152F | 0.41 | S152W |
| 159 | I | B45 | I159G | 0.92 | I159D | 0.78 | I159S | 0.59 | I159T |
| | | | I159P | 0.27 | I159F | 0.26 | I159W | 0.26 | I159E |
| 160 | A | B45 | A160F | 1.12 | A160E | 0.92 | A160P | 0.89 | A160G |
| 163 | L | B45 | L163F | 0.80 | L163Q | 0.72 | L163V | 0.60 | L163M |
| | | | L163E | 0.24 | L163G | 0.24 | L163S | 0.24 | L163R |
| 164 | D | B45 | D164A | 0.90 | D164S | 0.88 | D164G | 0.81 | D164M |
| | | | D164V | 0.54 | D164F | 0.51 | D164T | 0.49 | D164C |
| 166 | L | B45 | L166Q | 1.07 | L166D | 1.01 | L166M | 0.98 | L166P |
| | | | L166S | 0.95 | L166N | 0.92 | L166Y | 0.73 | L166F |
| 167 | N | B45 | N167R | 1.15 | N167G | 1.13 | N167S | 1.04 | N167C |
| | | | N167I | 0.67 | | | | | |
| 173 | A | B45 | A173N | 1.12 | A173P | 0.97 | A173G | 0.92 | A173V |
| 174 | I | B45 | I174V | 0.91 | I174Q | 0.89 | I174H | 0.77 | I174K |
| | | | I174S | 0.56 | I174R | 0.33 | I174D | 0.32 | |
| 177 | Q | B45 | Q177F | 1.10 | Q177N | 1.06 | Q177H | 1.05 | Q177Y |
| | | | Q177L | 0.89 | Q177D | 0.78 | Q177G | 0.74 | Q177K |
| 178 | Q | B45 | Q178E | 0.98 | Q178H | 0.92 | Q178W | 0.83 | Q178G |
| | | | Q178F | 0.53 | Q178Y | 0.50 | Q178L | 0.37 | Q178D |
| 179 | V | B45 | V179C | 1.01 | V179A | 0.86 | V179N | 0.80 | V179M |
| | | | V179R | 0.61 | V179F | 0.44 | V179W | 0.41 | V179D |
| 180 | P | B45 | P180C | 1.05 | P180K | 1.00 | P180T | 0.94 | P180V |
| | | | P180Y | 0.53 | P180W | 0.38 | P180D | 0.28 | |
| 201 | L | B45 | L201C | 0.79 | L201N | 0.67 | L201A | 0.64 | I201P |
| | | | L201H | 0.55 | L201R | 0.54 | L201D | 0.52 | |
| 206 | F | B45 | F206V | 1.00 | F206C | 0.86 | F206E | 0.76 | F206A |
| | | | F206S | 0.53 | F206D | 0.51 | F206K | 0.49 | F206N |
| 208 | L | B45 | L208F | 0.91 | L208I | 0.79 | L208Y | 0.71 | L208S |
| | | | L208Q | 0.44 | L208W | 0.44 | L208C | 0.39 | L208G |
| | | | L208D | 0.29 | | | | | |
| 209 | T | B45 | T209S | 0.94 | T209Q | 0.88 | T209I | 0.75 | T209G |
| 210 | S | B45 | S210G | 1.13 | | | | | |
| 211 | Q | B45 | Q211V | 1.17 | Q211K | 1.15 | Q211H | 1.10 | Q211E |
| | | | Q211S | 0.94 | Q211D | 0.54 | | | |
| 212 | E | B45 | E212F | 1.05 | E212A | 0.86 | E212V | 0.79 | E212N |
| | | | E212L | 0.64 | E212Q | 0.63 | E212K | 0.61 | E212S |
| 213 | I | B45 | I213C | 1.11 | I213S | 0.98 | I213R | 0.94 | I213E |
| | | | I213P | 0.59 | I213H | 0.58 | I213A | 0.49 | |
| 214 | Q | B21 | Q214S | 1.12 | Q214F | 1.05 | Q214Y | 1.01 | Q214D |
| | | | Q214T | 0.53 | Q214H | 0.52 | Q214L | 0.43 | Q214G |
| 215 | R | B45 | R215V | 0.95 | R215A | 0.94 | R215I | 0.85 | R215N |
| | | | R215S | 0.67 | R215G | 0.66 | R215T | 0.66 | R215P |
| 218 | E | B45 | E218G | 1.18 | E218L | 1.10 | E218C | 1.10 | E218K |
| 219 | R | B21 | R219Y | 1.15 | R219E | 1.13 | R219W | 1.08 | R219Q |
| | | | R219T | 0.05 | R219M | 0.03 | R219L | 0.01 | R219A |
| 221 | A | B45 | A221S | 1.16 | A221C | 1.03 | A221E | 0.91 | A221M |
| 222 | E | B45 | E222C | 1.13 | E222S | 1.11 | E222L | 1.10 | E222F |
| | | | E222R | 0.84 | E222P | 0.59 | | | |
| 225 | R | B45 | R225W | 1.19 | R225S | 1.17 | R225E | 1.14 | R225A |
| 226 | E | B45 | E226T | 1.18 | E226F | 1.17 | E226G | 1.15 | E226W |
| | | | E226H | 0.96 | E226Q | 0.96 | | | |
| 230 | Y | B45 | Y230F | 1.19 | Y230M | 1.15 | Y230R | 1.01 | Y230C |
| | | | Y230I | 0.63 | Y230V | 0.57 | Y230P | 0.53 | |
| 233 | R | B45 | R233E | 1.19 | R233V | 1.10 | R233F | 1.09 | R233N |
| | | | R233H | 0.50 | | | | | |
| 234 | W | B45 | W234G | 1.06 | W234K | 0.93 | W234T | 0.63 | W234E |
| 236 | N | B45 | N236Q | 1.18 | N236D | 1.16 | N236R | 1.08 | N236A |
| | | | N236M | 0.54 | N236C | 0.53 | N236W | 0.42 | |
| 240 | N | B45 | N240I | 1.18 | N240D | 1.17 | N240V | 1.16 | N240E |
| 241 | N | B45 | N241G | 1.17 | N241F | 1.16 | N241Q | 1.15 | N241E |
| | | | N241R | 0.49 | | | | | |
| 242 | L | B45 | L242M | 0.95 | L242I | 0.93 | L242C | 0.83 | L242R |
| | | | L242F | 0.49 | L242H | 0.46 | L242W | 0.40 | L242G |
| 243 | R | B45 | R243L | 0.98 | R243A | 0.86 | R243Y | 0.82 | R243F |
| | | | R243P | 0.46 | | | | | |
| 244 | G | B45 | G244C | 0.94 | G244L | 0.72 | G244A | 0.71 | G244Q |
| | | | G244Y | 0.53 | G244E | 0.53 | G244H | 0.47 | G244M |
| | | | G244I | 0.26 | | | | | |
| 245 | T | B45 | T245P | 0.96 | T245L | 0.82 | T245C | 0.71 | |
| 246 | N | B45 | N246A | 0.85 | N246K | 0.84 | N246P | 0.79 | N246E |
| | | | N246Y | 0.60 | N246V | 0.60 | N246I | 0.58 | |
| 247 | A | B45 | A247C | 0.52 | A247N | 0.52 | A247L | 0.41 | A247D |
| | | | A247Y | 0.30 | A247M | 0.28 | A247K | 0.28 | A247H |
| 248 | E | B45 | E248I | 1.11 | E248W | 1.06 | E248H | 1.01 | E248C |
| 252 | R | B45 | R252L | 1.09 | R252Y | 1.06 | R252K | 1.06 | R252G |
| | | | R252V | 0.92 | R252D | 0.90 | R252E | 0.79 | R252L |

TABLE 5-continued

| Pos | WT | Grp | Mut | Val | Mut | Val | Mut | Val | Mut | Val |
|---|---|---|---|---|---|---|---|---|---|---|
| 277 | R | B45 | R277H | 1.13 | R277N | 1.07 | R277C | 0.95 | R277E | |
|  |  |  | R277Y | 0.82 | R277D | 0.70 | R277A | 0.69 | R277I | |
| 280 | P | B45 | P280Q | 1.18 | P280Y | 1.08 | P280V | 0.98 | P280R | |
|  |  |  | P280G | 0.62 | P280A | 0.58 | P280S | 0.54 | P280D | |
| 281 | I | B45 | I281T | 1.15 | I281N | 1.14 | I281Y | 1.14 | I281C | |
| 303 | S | 258 | S303A | 1.09 | S303M | 0.95 | S303L | 0.70 | S303Y | |
|  |  |  | S303F | 0.56 | S303C | 0.43 | S303Q | 0.39 | S303V | |
|  |  |  | S303R | 0.03 |  |  |  |  |  | |
| 304 | G | 258 | G304N | 0.22 | G304C | 0.02 | G304S | 0.01 | G304A | |
|  |  |  | G304E | 0.01 | G304Q | 0.01 | G304K | 0.01 | G304P | |
|  |  |  | G304D | 0.01 | G304M | 0.00 | G304Y | 0.00 |  | |
| 305 | F | 258 | F305A | 0.07 | F305Q | 0.03 | F305N | 0.03 | F305M | |
|  |  |  | F305V | 0.01 | F305K | 0.01 | F305E | 0.01 | F305D | |
|  |  |  | F305H | 0.00 | F305P | 0.00 | F305Y | 0.00 |  | |
| 306 | A | 258 | A306Q | 1.14 | A306K | 0.96 | A306N | 0.93 | A306S | |
|  |  |  | A306W | 0.44 | A306L | 0.33 | A306F | 0.30 | A306I | |
|  |  |  | A306E | 0.02 |  |  |  |  |  | |
| 308 | T | 258 | T308S | 0.63 | T308A | 0.03 | T308G | 0.02 | T308K | |
|  |  |  | T308N | 0.01 | T308E | 0.01 | T308R | 0.01 | T308D | |
|  |  |  | T308Y | 0.01 | T308W | 0.01 | T308H | 0.00 |  | |
| 360 | R | B21 | R360K | 0.97 | R360A | 0.94 | R360G | 0.66 | R360H | |
| 362 | E | B21 | N362Q | 1.20 | N362M | 1.16 | N362C | 0.95 | N362T | |
| 364 | R | B21 | R364G | 1.02 | R364S | 0.89 | R364A | 0.39 | R364K | |
| 367 | R | B21 | G367S | 1.09 | G367M | 0.97 | G367C | 0.53 | G367F | |
| 406 | L | 258 | L406I | 0.76 | L406W | 0.53 | L406A | 0.39 | L406F | |
|  |  |  | L406N | 0.23 | L406K | 0.13 | L406T | 0.05 | L406S | |
|  |  |  | L406E | 0.01 |  |  |  |  |  | |
| 407 | L | 258 | L407E | 1.13 | L407D | 1.00 | L407V | 0.66 | L407C | |
|  |  |  | L407N | 0.20 | L407M | 0.11 | L407H | 0.11 | L407S | |
| 408 | T | 258 | T408A | 0.96 | T408Y | 0.54 | T408S | 0.48 | T408V | |
|  |  |  | T408R | 0.26 | T408H | 0.25 | T408K | 0.25 | T408F | |
|  |  |  | T408G | 0.08 | T408E | 0.02 |  |  |  | |
| 409 | T | 258 | T409Q | 0.53 | T409M | 0.30 | T409A | 0.26 | T409I | |
|  |  |  | T409H | 0.11 | T409W | 0.11 | T409E | 0.10 | T409R | |
|  |  |  | T409D | 0.01 | T409P | 0.01 | T409G | 0.01 |  | |
| 411 | V | 258 | V411I | 0.82 | V411M | 0.52 | V411L | 0.51 | V411C | |
|  |  |  | V411H | 0.12 | V411W | 0.11 | V411A | 0.10 | V411F | |
|  |  |  | V411Y | 0.02 | V411D | 0.01 | V411P | 0.01 |  | |
| 418 | R | B21 | R418S | 1.13 | R418A | 1.11 | R418L | 1.09 | R418H | |
|  |  |  | R418Y | 0.76 | R418M | 0.69 | R418E | 0.63 | R418G | |
|  |  |  | R418P | 0.14 |  |  |  |  |  | |
| 420 | N | B21 | N420D | 1.11 | N420Y | 1.10 | N420E | 1.04 | N420P | |
|  |  |  | N420V | 0.81 | N420M | 0.74 | N420K | 0.71 | N420T | |
|  |  |  | N420I | 0.60 | N420C | 0.50 | N420A | 0.47 |  | |
| 422 | R | B21 | R422Q | 1.13 | R422S | 1.13 | R422Y | 1.06 | R422A | |
|  |  |  | R422N | 0.79 | R422D | 0.77 | R422W | 0.74 | R422M | |
|  |  |  | R422F | 0.59 | R422I | 0.51 | R422P | 0.03 |  | |
| 425 | L | B21 | L425V | 1.19 | L425A | 1.16 | L425Y | 1.15 | L425M | |
|  |  |  | L425Q | 0.93 | L425I | 0.93 | L425W | 0.93 | L425N | |
|  |  |  | L425D | 0.54 |  |  |  |  |  | |
| 426 | N | B21 | N426M | 1.17 | N426S | 1.09 | N426D | 1.05 | N426Y | |
|  |  |  | N426Q | 0.83 | N426R | 0.80 | N426T | 0.77 | N426G | |
|  |  |  | N426C | 0.34 | N426W | 0.31 | N426P | 0.29 |  | |
| 427 | S | B21 | S427H | 1.20 | S427P | 1.14 | S427Q | 1.13 | S427N | |
|  |  |  | S427F | 0.87 | S427I | 0.84 | S427E | 0.83 | S427M | |
|  |  |  | S427V | 0.53 | S427R | 0.48 |  |  |  | |
| 428 | L | B21 | L428N | 1.15 | L428Q | 1.08 | L428G | 1.07 | L428P | |
|  |  |  | L428S | 0.82 | L428W | 0.76 | L428A | 0.74 | L428V | |
|  |  |  | L428K | 0.52 | L428F | 0.42 | L428C | 0.28 |  | |
| 429 | R | B21 | R429L | 1.13 | R429H | 1.09 | R429W | 1.09 | R429N | |
|  |  |  | R429Y | 0.88 | R429Q | 0.86 | R429T | 0.83 | R429G | |
|  |  |  | R429S | 0.54 | R429C | 0.36 |  |  |  | |
| 431 | S | B21 | S431K | 1.15 | S431M | 1.00 | S431V | 0.90 | S431T | |
|  |  |  | S431R | 0.81 | S431N | 0.81 | S431I | 0.73 | S431W | |
| 435 | T | B21 | T435M | 1.13 | T435W | 1.01 | T435F | 1.00 | T435I | |
|  |  |  | T435N | 0.57 | T435D | 0.55 | T435E | 0.52 | T435A | |
| 437 | G | B21 | G437M | 1.15 | G437T | 1.13 | G437Y | 1.00 | G437F | |
|  |  |  | G437I | 0.75 | G437E | 0.67 | G437D | 0.62 | G437P | |
| 439 | T | B21 | T439S | 1.20 | T439F | 1.16 | T439V | 1.16 | T439A | |
|  |  |  | T439K | 0.83 | T439R | 0.80 | T439L | 0.79 | T439G | |
|  |  |  | T439P | 0.02 |  |  |  |  |  | |
| 444 | Q | B21 | Q444E | 0.91 | Q444M | 0.89 | Q444A | 0.62 | Q444H | |
|  |  |  | Q444F | 0.34 | Q444D | 0.31 | Q444N | 0.28 | Q444K | |
|  |  |  | Q444C | 0.10 | Q444R | 0.05 | Q444P | 0.01 |  | |
| 447 | D | B21 | D447Q | 1.17 | D447Y | 1.16 | D447K | 1.01 | D447G | |
|  |  |  | D447R | 0.63 | D447P | 0.52 | D447C | 0.52 |  | |
| 473 | R | B21 | R473H | 1.07 | R473C | 1.07 | R473L | 1.02 | R473Q | |
| 476 | S | B21 | I476K | 1.13 | I476T | 1.12 | I476N | 1.07 | I476C | |
| 477 | G | B21 | G477R | 1.04 | G477T | 1.01 | G477Q | 0.90 | G477K | |
|  |  |  | G477Y | 0.24 | G477C | 0.13 | G477W | 0.04 |  | |

TABLE 5-continued

| | | | | | | | | |
|---|---|---|---|---|---|---|---|---|
| 478 | N | B21 | N478Q | 1.14 | N478R | 1.12 | N478H | 1.06 | N478T |
| | | | N478D | 0.31 | N478F | 0.26 | N478C | 0.13 | |
| 479 | T | B21 | T479G | 1.00 | T479I | 0.93 | T479L | 0.81 | T479S |
| | | | T479P | 0.40 | T479R | 0.30 | T479M | 0.23 | T479F |
| 481 | R | B21 | R481K | 0.65 | R481L | 0.48 | R481W | 0.30 | R481Y |
| | | | R481A | 0.13 | R481S | 0.13 | R481G | 0.07 | R481E |
| 492 | A | B25 | A492S | 0.93 | A492C | 0.70 | A492V | 0.69 | A492G |
| 498 | I | B25 | I498V | 1.02 | I498E | 0.93 | I498L | 0.90 | I498C |
| | | | I498R | 0.27 | | | | | |
| 499 | A | B25 | A499D | 1.09 | | | | | |
| 503 | I | B25 | I503C | 0.63 | I503L | 0.59 | I503V | 0.44 | |
| 504 | T | B25 | T504S | 0.78 | T504G | 0.66 | T504A | 0.63 | T504C |
| 505 | Q | B25 | Q505C | 0.34 | Q505L | 0.28 | Q505E | 0.26 | Q505S |
| 506 | I | B25 | I506L | 0.96 | I506V | 0.94 | I506W | 0.19 | I506A |
| 507 | P | B25 | P507A | 0.44 | P507G | 0.34 | P507S | 0.29 | |
| 508 | A | B25 | A508V | 0.91 | A508M | 0.64 | A508S | 0.48 | A508I |
| 509 | V | B25 | V509I | 0.95 | V509C | 0.86 | V509N | 0.86 | V509G |
| | | | V509D | 0.31 | V509E | 0.24 | | | |
| 511 | G | B25 | G511A | 0.88 | G511S | 0.62 | | | |
| 512 | N | 258 | N512S | 1.13 | N512C | 1.10 | N512H | 1.08 | N512L |
| 513 | F | B25 | F513R | 1.18 | F513A | 1.02 | F513Y | 0.91 | F513M |
| 514 | L | | | | | | | | |
| 515 | F | B25 | F515W | 1.04 | F515G | 0.60 | F515R | 0.56 | F515V |
| | | | F515S | 0.43 | F515E | 0.22 | F515D | 0.19 | |
| 517 | G | B25 | G517V | 0.39 | | | | | |
| 520 | I | B25 | I520G | 1.02 | I520N | 0.93 | | | |
| 525 | F | B25 | F525T | 0.82 | F525S | 0.79 | F525V | 0.77 | F525W |
| 526 | T | B25 | T526A | 0.79 | T526S | 0.70 | T526V | 0.69 | T526G |
| 527 | G | B25 | G527T | 0.45 | G527S | 0.23 | | | |
| 530 | L | B25 | L530I | 0.86 | L530V | 0.80 | L530C | 0.56 | L530Y |
| | | | L530K | 0.22 | | | | | |
| 531 | V | B25 | V531I | 0.96 | V531C | 0.75 | V531A | 0.21 | |
| 533 | L | B25 | L533I | 0.86 | L533N | 0.62 | L533V | 0.56 | V531A |
| 534 | N | B25 | N534R | 1.17 | N534V | 1.12 | N534M | 1.04 | N534A |
| 535 | N | B25 | N535G | 1.10 | N535C | 0.92 | N535V | 0.91 | |
| 536 | S | 258 | S536Y | 1.03 | S536T | 1.02 | S536A | 0.85 | S536N |
| | | | S536F | 0.55 | S536G | 0.49 | S536W | 0.47 | S536D |
| | | | S536R | 0.18 | S536L | 0.11 | S536I | 0.09 | |
| 537 | G | 258 | G537L | 1.18 | G537M | 1.17 | G537I | 1.06 | G537C |
| 538 | N | 258 | N538K | 1.17 | N538Y | 0.98 | N538R | 0.80 | |
| 539 | N | B25 | N539D | 0.95 | N539A | 0.92 | N539S | 0.88 | N539H |
| | | | N539T | 0.57 | N539V | 0.56 | N539G | 0.51 | N539C |
| 540 | I | B25 | I540V | 0.90 | I540H | 0.86 | I540S | 0.84 | I540P |
| 541 | Q | 258 | Q541H | 0.92 | Q541G | 0.71 | Q541A | 0.62 | Q541S |
| | | | Q541K | 0.20 | Q541R | 0.12 | | | |
| 542 | N | B25 | N542R | 0.87 | N542M | 0.86 | N542A | 0.65 | N542L |
| | | | N542S | 0.50 | N542G | 0.41 | N542V | 0.31 | N542I |
| 543 | R | 258 | R543Y | 0.1104 | R543H | 0.0972 | R543G | 0.068 | R543W |
| | | | R543A | 0.0329 | R543V | 0.0262 | R543C | 0.0171 | R543Q |
| 545 | Y | 258 | Y545A | 0.39 | Y545L | 0.34 | Y545C | 0.28 | Y545V |
| | | | Y545K | 0.19 | Y545R | 0.11 | Y545G | 0.10 | |
| 546 | L | B25 | I546V | 1.04 | I546L | 1.02 | I546M | 1.01 | I546F |
| 547 | E | 258 | E547K | 1.11 | E547V | 1.04 | E547R | 1.01 | E547Y |
| | | | E547C | 0.53 | E547W | 0.28 | E547D | 0.28 | E547F |
| 548 | V | B25 | V548L | 1.02 | V548S | 0.58 | V548A | 0.57 | V548G |
| 549 | P | B25 | P549Y | 0.52 | P549V | 0.38 | P549T | 0.50 | P549S |
| | | | P549D | 0.78 | P549C | 0.89 | | | |
| 550 | I | B25 | I550V | 0.96 | I550L | 0.95 | I550A | 0.61 | I550F |
| 551 | Q | B25 | Q551V | 1.12 | Q551F | 1.09 | Q551M | 1.05 | Q551G |
| 552 | F | B25 | F552C | 1.10 | F552D | 1.06 | F552G | 1.00 | F552A |
| 553 | I | B25 | I553N | 1.12 | | | | | |
| 554 | S | B25 | S554M | 0.93 | | | | | |
| 555 | T | B25 | T555R | 1.13 | T555C | 1.13 | T555S | 0.85 | T555G |
| 557 | T | B25 | T557L | 1.16 | T557W | 1.05 | | | |
| 558 | R | B25 | R558A | 1.11 | | | | | |
| 559 | Y | B25 | Y559L | 0.67 | Y559M | 0.63 | Y559V | 0.61 | Y559A |
| | | | Y559R | 0.10 | Y559P | 0.07 | Y559G | 0.05 | |
| 563 | V | B25 | V563G | 1.05 | V563S | 0.69 | V563C | 0.64 | V563T |
| 564 | R | B25 | R564M | 1.04 | R564G | 0.78 | R564L | 0.24 | R564P |
| 568 | V | B25 | V568P | 1.17 | | | | | |
| 569 | T | B25 | T569V | 1.19 | T569E | 1.15 | T569L | 1.12 | T569R |
| 570 | P | 258 | P570A | 1.15 | P570K | 1.08 | P570G | 1.07 | P570Y |
| | | | P570S | 0.89 | P570Q | 0.79 | P570N | 0.79 | P570C |
| 571 | I | B25 | I571E | 1.09 | I571A | 0.90 | | | |
| 572 | Q | 258 | Q572G | 1.16 | Q572T | 1.07 | Q572Y | 1.07 | Q572N |
| 574 | S | 258 | S574V | 0.82 | S574I | 0.76 | S574M | 0.69 | S574W |
| | | | S574N | 0.48 | S574L | 0.38 | S574E | 0.32 | S574P |
| 577 | W | 258 | W577L | 1.18 | W577N | 1.16 | W577C | 1.08 | W577S |

TABLE 5-continued

| | | | | | | | | |
|---|---|---|---|---|---|---|---|---|
| 581 | N | 258 | N581I | 1.02 | N581G | 1.02 | N581F | 1.00 | N581T |
| | | | N581P | 0.63 | N581W | 0.58 | N581E | 0.57 | N581Q |
| | | | N581R | 0.00 | | | | | |
| 584 | S | B21 | S584K | 1.14 | S584G | 1.11 | S584A | 1.00 | S584Q |
| | | | S584L | 0.66 | S584H | 0.65 | S584T | 0.64 | S584F |
| | | | S584E | 0.21 | S584P | 0.12 | | | |
| 585 | S | 258 | S585E | 1.11 | S585Y | 1.09 | S585G | 0.93 | S585P |
| 590 | T | B25 | T590K | 1.00 | T590V | 0.98 | T590M | 0.73 | T590W |
| 591 | A | 258 | A591I | 1.17 | A591G | 1.17 | A591M | 0.94 | |
| 592 | T | 258 | T592E | 1.04 | T592C | 0.66 | | | |
| 593 | S | B21 | S593A | 1.10 | S593F | 1.07 | S593L | 1.06 | S593Q |
| | | | S593I | 0.87 | S593W | 0.84 | S593E | 0.80 | S593K |
| 595 | D | B21 | D595L | 1.19 | D595W | 1.18 | D595Q | 1.13 | D595C |
| 596 | N | B21 | N596F | 1.14 | N596C | 1.10 | N596Q | 1.06 | N596M |
| 598 | Q | B21 | Q598H | 1.03 | Q598F | 1.03 | Q598Y | 1.02 | Q598R |
| | | | Q598P | 0.82 | Q598M | 0.80 | Q598A | 0.76 | Q598T |
| 599 | S | B25 | S599G | 1.09 | S599D | 1.07 | S599I | 0.85 | S599W |
| 600 | R | B21 | R600G | 0.88 | R600S | 0.85 | R600M | 0.77 | R600A |
| | | | R600V | 0.65 | R600Q | 0.60 | R600I | 0.57 | R600H |
| | | | R600Y | 0.36 | R600D | 0.34 | R600W | 0.31 | |
| 601 | D | B21 | N601Q | 1.14 | N601W | 1.07 | N601T | 1.00 | N601A |
| | | | N601R | 0.73 | N601C | 0.73 | N601I | 0.64 | N601D |
| 602 | F | B25 | F602L | 1.15 | F602V | 0.75 | F602Y | 0.70 | F602K |
| 605 | F | 258 | F605H | 1.12 | F605T | 0.96 | F605L | 0.83 | |
| 606 | E | B21 | E606C | 1.15 | E606V | 1.03 | E606S | 0.97 | E606D |
| 607 | S | 258 | S607N | 1.14 | S607H | 1.08 | S607K | 1.01 | S607M |
| | | | S607L | 0.75 | | | | | |
| 608 | T | 258 | T608M | 1.19 | T608H | 1.16 | T608E | 1.05 | T608D |
| 609 | N | B25 | N609D | 0.74 | | | | | |
| 612 | T | B25 | T612A | 1.17 | T612L | 1.09 | T612K | 0.97 | T612Y |
| 613 | S | B25 | S613E | 1.01 | S613L | 0.98 | S613A | 0.97 | |
| 614 | A | B25 | A614W | 1.15 | A614P | 1.14 | A614Q | 0.98 | |
| 617 | N | B25 | N617E | 1.19 | N617S | 1.14 | N617F | 0.96 | |
| 618 | V | 258 | V618F | 1.17 | V618Y | 1.11 | V618M | 1.10 | V618A |
| | | | V618S | 0.70 | V618C | 0.69 | V618Q | 0.67 | |
| 620 | G | B25 | G620S | 0.38 | G620A | 0.35 | G620E | 0.27 | G620L |
| | | | G620W | 0.21 | G620R | 0.20 | G620M | 0.15 | |
| 622 | R | B25 | R622H | 0.28 | R622W | 0.20 | R622C | 0.19 | R622E |
| 623 | N | B25 | N623S | 1.19 | N623A | 1.14 | N623D | 0.88 | N623H |
| | | | N623I | 0.57 | | | | | |
| 624 | F | B25 | F624M | 1.14 | F624E | 0.86 | F624V | 0.76 | F624S |
| | | | F624T | 0.33 | | | | | |
| 626 | E | 258 | E626D | 1.18 | E626L | 1.10 | E626F | 1.09 | E626C |
| 628 | A | B25 | A628E | 1.15 | A628T | 1.14 | | | |
| 629 | G | 258 | G629C | 1.18 | G629L | 1.15 | G629H | 1.08 | G629I |
| | | | G629F | 0.85 | G629Y | 0.81 | | | |
| 630 | V | B25 | V630I | 1.12 | V630T | 1.08 | V630L | 0.82 | V630G |
| 641 | T | B25 | T641M | 1.18 | T641C | 0.98 | T641K | 0.97 | |
| 643 | T | B25 | T643V | 1.14 | T643P | 0.98 | T643E | 0.93 | T643F |
| 645 | E | B25 | E645R | 1.16 | E645F | 1.13 | E645D | 0.75 | |
| 646 | A | B25 | A646N | 1.08 | A646Q | 1.06 | | | |

| MP258 position | FAE | Variant | FAE | Variant | FAE | Variant | FAE | Variant | FAE |
|---|---|---|---|---|---|---|---|---|---|
| 50 | 0.89 | L50G | 0.73 | | | | | | |
| 53 | 1.08 | A53M | 1.06 | A53S | 0.55 | | | | |
| 54 | 1.08 | S54V | 1.03 | S54N | 0.99 | S54E | 0.95 | S54T | 0.89 |
| 57 | 1.13 | Q57F | 0.91 | | | | | | |
| 65 | 0.99 | R65V | 0.94 | R65F | 0.87 | R65E | 0.74 | R65P | 0.53 |
| 67 | 0.52 | L67E | 0.52 | L67Y | 0.51 | L67T | 0.51 | L67R | 0.50 |
| | 0.46 | L67G | 0.44 | | | | | | |
| 68 | 0.62 | G68V | 0.60 | G68S | 0.54 | G68I | 0.50 | G68N | 0.50 |
| 70 | 0.98 | L70F | 0.97 | L70C | 0.97 | L70N | 0.96 | L70G | 0.92 |
| | 0.87 | L70D | 0.85 | | | | | | |
| 71 | 1.00 | G71R | 1.00 | G71K | 0.96 | G71A | 0.88 | G71I | 0.87 |
| | 0.61 | G71Y | 0.26 | G71W | 0.25 | G71T | 0.22 | | |
| 72 | 0.79 | V72Y | 0.75 | V72I | 0.74 | V72N | 0.72 | V72H | 0.66 |
| | 0.55 | V72E | 0.35 | V72P | 0.28 | | | | |
| 73 | 0.33 | | | | | | | | |
| 74 | 1.00 | F74H | 0.91 | F74K | 0.88 | F74A | 0.82 | F74Y | 0.80 |
| 75 | 0.83 | A75L | 0.59 | A75T | 0.59 | A75G | 0.57 | A75I | 0.29 |
| 76 | 0.54 | G76C | 0.52 | G76N | 0.51 | G76L | 0.50 | G76F | 0.48 |
| 77 | 0.96 | | | | | | | | |
| 79 | | | | | | | | | |
| 80 | | | | | | | | | |
| 83 | 0.58 | S83W | 0.53 | | | | | | |
| 87 | 0.97 | G87V | 0.92 | G87T | 0.69 | G87Q | 0.50 | G87I | 0.46 |
| 91 | 1.05 | P91F | 1.01 | P91M | 0.67 | P91L | 0.55 | P91V | 0.55 |
| | 0.50 | | | | | | | | |

TABLE 5-continued

| Pos | Val | Mut | Val | Mut | Val | Mut | Val | Mut | Val |
|---|---|---|---|---|---|---|---|---|---|
| 92 | 0.70 | S92A | 0.39 | S92P | 0.32 | | | | |
| 93 | 0.86 | G93A | 0.83 | G93T | 0.82 | G93S | 0.80 | G93K | 0.75 |
| | 0.53 | | | | | | | | |
| 94 | 0.92 | R94A | 0.88 | R94W | 0.88 | R94N | 0.77 | R94I | 0.71 |
| 95 | 0.83 | D95K | 0.80 | D95S | 0.64 | D95E | 0.50 | D95A | 0.28 |
| 106 | 0.96 | Q106T | 0.52 | | | | | | |
| 108 | 1.04 | V108E | 0.95 | V108W | 0.83 | | | | |
| 109 | 0.97 | R109H | 0.92 | R109L | 0.91 | R109E | 0.91 | R109G | 0.86 |
| | 0.79 | R109M | 0.74 | R109C | 0.73 | R109Y | 0.49 | R109P | 0.07 |
| 110 | 1.14 | Q110N | 1.13 | Q110E | 1.09 | Q110S | 1.09 | Q110L | 0.89 |
| | 0.70 | Q110P | 0.15 | | | | | | |
| 111 | 1.01 | Q111P | 0.85 | Q111T | 0.79 | Q111C | 0.77 | Q111Y | 0.50 |
| 112 | 0.57 | I112T | 0.57 | I112E | 0.39 | I112Y | 0.28 | I112N | 0.28 |
| | 0.24 | I112W | 0.24 | | | | | | |
| 113 | 0.73 | T113I | 0.61 | | | | | | |
| 114 | 0.41 | E114P | 0.09 | | | | | | |
| 115 | 0.88 | N115V | 0.87 | N115D | 0.82 | N115L | 0.69 | N115C | 0.61 |
| | 0.24 | | | | | | | | |
| 118 | 0.84 | N118M | 0.60 | | | | | | |
| 119 | 0.84 | T119L | 0.78 | T119C | 0.62 | T119G | 0.50 | T119N | 0.42 |
| 122 | 1.04 | A122D | 1.01 | A122V | 1.00 | A122K | 0.96 | A122C | 0.96 |
| 123 | 0.63 | R123T | 0.61 | R123V | 0.61 | R123L | 0.61 | R123F | 0.57 |
| | 0.46 | R123C | 0.43 | R123W | 0.42 | R123D | 0.32 | R123E | 0.28 |
| 125 | | | | | | | | | |
| 129 | 1.06 | A129C | 1.05 | A129M | 0.91 | A129G | 0.90 | A129N | 0.87 |
| 132 | 0.89 | R132L | 0.86 | R132Q | 0.80 | R132S | 0.72 | R132E | 0.70 |
| | 0.59 | R132C | 0.59 | R132P | 0.36 | | | | |
| 133 | 0.54 | A133G | 0.47 | A133P | 0.36 | A133H | 0.33 | A133M | 0.32 |
| | 0.26 | A133R | 0.23 | A133Q | | | | | |
| 136 | 0.92 | Q136V | 0.59 | | | | | | |
| 140 | 0.40 | D140Q | 0.40 | D140M | 0.36 | D140C | 0.36 | D140K | 0.30 |
| 142 | 0.73 | L142A | 0.67 | L142G | 0.67 | L142Y | 0.66 | L142M | 0.62 |
| | 0.43 | | | | | | | | |
| 143 | | | | | | | | | |
| 144 | 0.94 | N144E | 0.86 | N144G | 0.84 | N144D | 0.52 | | |
| 145 | 0.94 | R145C | 0.69 | | | | | | |
| 146 | 1.11 | D146R | 1.05 | D146N | 1.05 | D146L | 1.01 | D146Q | 0.95 |
| 147 | 0.62 | N147F | 0.61 | N147I | 0.59 | N147P | 0.57 | N147M | 0.55 |
| 148 | 0.90 | A148Y | 0.87 | A148T | 0.85 | A148S | 0.84 | A148D | 0.83 |
| 149 | 0.94 | R149Y | 0.87 | R149P | 0.84 | R149G | 0.82 | R149C | 0.24 |
| 151 | 0.69 | R151L | 0.68 | R151G | 0.63 | R151T | 0.56 | R151Q | 0.52 |
| | 0.39 | R151W | 0.39 | R151E | 0.38 | R151P | 0.32 | R151D | 0.32 |
| 152 | 0.89 | S152L | 0.83 | S152I | 0.76 | S152R | 0.61 | S152G | 0.60 |
| | 0.37 | S152D | 0.32 | S152V | 0.25 | | | | |
| 159 | 0.32 | I159R | 0.32 | I159Y | 0.29 | I159N | 0.28 | I159M | 0.28 |
| | 0.26 | I159Q | 0.25 | I159L | 0.25 | | | | |
| 160 | 0.85 | A160K | 0.82 | A160T | 0.81 | A160I | 0.75 | | |
| 163 | 0.56 | L163C | 0.28 | L163A | 0.28 | L163K | 0.27 | L163P | 0.26 |
| | 0.24 | L163D | 0.23 | L163N | 0.23 | | | | |
| 164 | 0.81 | D164R | 0.72 | D164N | 0.71 | D164L | 0.63 | D164Y | 0.56 |
| | 0.49 | D164I | 0.42 | D164E | 0.30 | D164P | 0.25 | | |
| 166 | 0.98 | L166H | 0.98 | L166G | 0.97 | L166R | 0.96 | L166K | 0.96 |
| | 0.62 | L166S | 0.95 | | | | | | |
| 167 | 0.98 | N167F | 0.92 | N167E | 0.90 | N167D | 0.87 | N167P | 0.83 |
| 173 | 0.88 | A173S | 0.77 | A173E | 0.56 | | | | |
| 174 | 0.73 | I174G | 0.72 | I174M | 0.72 | I174E | 0.63 | I174N | 0.59 |
| 177 | 1.01 | Q177I | 1.00 | Q177R | 0.96 | Q177M | 0.95 | Q177V | 0.93 |
| | 0.40 | | | | | | | | |
| 178 | 0.78 | Q178S | 0.75 | Q178V | 0.74 | Q178P | 0.67 | Q178I | 0.54 |
| | 0.31 | | | | | | | | |
| 179 | 0.80 | V179E | 0.77 | V179S | 0.75 | V179P | 0.67 | V179G | 0.61 |
| | 0.37 | | | | | | | | |
| 180 | 0.88 | P180G | 0.83 | P180F | 0.62 | P180R | 0.60 | P180N | 0.56 |
| 201 | 0.64 | I201Q | 0.62 | L201G | 0.61 | L201W | 0.60 | L201Y | 0.60 |
| 206 | 0.75 | F206Y | 0.74 | F206Q | 0.69 | F206G | 0.58 | F206R | 0.53 |
| | 0.47 | F206P | 0.37 | | | | | | |
| 208 | 0.71 | L208E | 0.67 | L208V | 0.66 | L208M | 0.56 | L208H | 0.50 |
| | 0.37 | L208T | 0.35 | L208A | 0.35 | L208P | 0.34 | L208R | 0.30 |
| 209 | 0.68 | T209W | 0.67 | T209F | 0.64 | T209Y | 0.62 | T209P | 0.28 |
| 210 | | | | | | | | | |
| 211 | 1.08 | Q211W | 1.03 | Q211F | 1.01 | Q211Y | 1.01 | Q211C | 1.00 |
| 212 | 0.78 | E212P | 0.77 | E212C | 0.72 | E212T | 0.68 | E212G | 0.64 |
| | 0.59 | E212R | 0.56 | | | | | | |
| 213 | 0.91 | I213W | 0.74 | I213D | 0.67 | I213Y | 0.63 | I213F | 0.62 |
| 214 | 0.76 | Q214V | 0.68 | Q214C | 0.67 | Q214E | 0.58 | Q214I | 0.53 |
| | 0.40 | Q214K | 0.28 | Q214R | 0.27 | | | | |
| 215 | 0.83 | R215Y | 0.77 | R215F | 0.75 | R215Q | 0.73 | R215K | 0.72 |
| | 0.59 | R215D | 0.56 | R215E | 0.54 | | | | |
| 218 | 1.08 | E218R | 0.93 | E218F | 0.92 | E218P | 0.55 | | |

TABLE 5-continued

| Pos | Val | Mut | Val | Mut | Val | Mut | Val | Mut | Val |
|---|---|---|---|---|---|---|---|---|---|
| 219 | 0.71 | R219K | 0.63 | R219D | 0.53 | R219P | 0.23 | R219H | 0.07 |
|  | 0.01 | R219V | 0.01 | R219I | 0.01 | R219C | 0.00 |  |  |
| 221 | 0.83 | A221P | 0.62 | A221Q | 0.50 |  |  |  |  |
| 222 | 1.10 | E222A | 0.98 | E222N | 0.98 | E222V | 0.94 | E222W | 0.90 |
| 225 | 1.02 | R225P | 0.87 | R225K | 0.85 | R225T | 0.77 |  |  |
| 226 | 1.13 | E226N | 1.11 | E226M | 1.05 | E226I | 1.00 | E226L | 0.98 |
| 230 | 0.93 | Y230T | 0.93 | Y230D | 0.88 | Y230N | 0.85 | Y230G | 0.81 |
| 233 | 1.05 | R233L | 1.03 | R233M | 1.01 | R233S | 0.87 | R233C | 0.78 |
| 234 | 0.60 | W234D | 0.59 | W234P | 0.46 | W234Q | 0.45 |  |  |
| 236 | 1.04 | N236I | 0.93 | N236Y | 0.89 | N236V | 0.89 | N236G | 0.58 |
| 240 | 0.57 | N240P | 0.44 |  |  |  |  |  |  |
| 241 | 1.13 | N241T | 1.12 | N241D | 1.07 | N241H | 0.90 | N241P | 0.50 |
| 242 | 0.75 | L242S | 0.70 | L242Q | 0.68 | L242A | 0.66 | L242N | 0.58 |
|  | 0.39 | L242Y | 0.33 | L242K | 0.32 |  |  |  |  |
| 243 | 0.76 | R243H | 0.73 | R243W | 0.71 | R243G | 0.67 | R243D | 0.57 |
| 244 | 0.60 | G244S | 0.58 | G244D | 0.56 | G244K | 0.54 | G244R | 0.54 |
|  | 0.47 | G244N | 0.46 | G244T | 0.37 | G244V | 0.28 | G244P | 0.28 |
| 245 |  |  |  |  |  |  |  |  |  |
| 246 | 0.78 | N246M | 0.77 | N246R | 0.76 | N246F | 0.66 | N246L | 0.61 |
| 247 | 0.41 | A247V | 0.39 | A247W | 0.39 | A247R | 0.31 | A247F | 0.30 |
|  | 0.25 |  |  |  |  |  |  |  |  |
| 248 | 0.82 | E248G | 0.76 | E248M | 0.74 | E248K | 0.50 |  |  |
| 252 | 1.05 | R252M | 1.05 | R252S | 0.99 | R252Q | 0.98 | R252H | 0.96 |
|  | 0.76 | R252P | 0.66 | R252T | 0.48 |  |  |  |  |
| 277 | 0.88 | R277W | 0.87 | R277S | 0.87 | R277F | 0.86 | R277T | 0.85 |
|  | 0.55 | R277P | 0.47 |  |  |  |  |  |  |
| 280 | 0.90 | P280F | 0.90 | P280W | 0.87 | P280E | 0.86 | P280K | 0.64 |
|  | 0.50 | P280I | 0.47 | P280L | 0.46 |  |  |  |  |
| 281 | 1.07 | I281G | 1.00 | I281F | 0.94 | I281W | 0.82 | I281D | 0.72 |
| 303 | 0.66 | S303G | 0.64 | S303I | 0.61 | S303T | 0.57 | S303H | 0.57 |
|  | 0.37 | S303W | 0.29 | S303D | 0.15 | S303K | 0.13 | S303E | 0.07 |
| 304 | 0.01 | G304I | 0.01 | G304L | 0.01 | G304T | 0.01 | G304F | 0.01 |
|  | 0.01 | G304R | 0.01 | G304H | 0.01 | G304W | 0.01 | G304V | 0.01 |
| 305 | 0.02 | F305I | 0.01 | F305L | 0.01 | F305R | 0.01 | F305G | 0.01 |
|  | 0.00 | F305C | 0.00 | F305W | 0.00 | F305T | 0.00 | F305S | 0.00 |
| 306 | 0.87 | A306M | 0.78 | A306Y | 0.00 | A306H | 0.50 | A306R | 0.48 |
|  | 0.30 | A306V | 0.26 | A306P | 0.22 | A306D | 0.09 | A306C | 0.07 |
| 308 | 0.02 | T308F | 0.02 | T308Q | 0.01 | T308V | 0.01 | T308C | 0.01 |
|  | 0.01 | T308L | 0.01 | T308I | 0.01 | T308P | 0.01 | T308M | 0.01 |
| 360 | 0.63 | R360Q | 0.44 | R360E | 0.41 | R360L | 0.28 |  |  |
| 362 | 0.88 |  |  |  |  |  |  |  |  |
| 364 | 0.38 | R364M | 0.25 |  |  |  |  |  |  |
| 367 | 0.38 |  |  |  |  |  |  |  |  |
| 406 | 0.31 | L406C | 0.29 | L406V | 0.27 | L406Q | 0.27 | L406H | 0.24 |
|  | 0.03 | L406Y | 0.03 | L406G | 0.02 | L406D | 0.01 | L406P | 0.01 |
| 407 | 0.56 | L407F | 0.46 | L407A | 0.41 | L407R | 0.34 | L407T | 0.34 |
|  | 0.10 | L407G | 0.06 | L407K | 0.04 | L407Q | 0.02 | L407P | 0.01 |
| 408 | 0.47 | T408L | 0.36 | T408M | 0.32 | T408Q | 0.30 | T408N | 0.27 |
|  | 0.24 | T408P | 0.22 | T408W | 0.20 | T408I | 0.17 | T408C | 0.11 |
| 409 | 0.21 | T409V | 0.20 | T409L | 0.17 | T409S | 0.16 | T409K | 0.13 |
|  | 0.10 | T409Y | 0.08 | T409N | 0.08 | T409F | 0.05 | T409C | 0.02 |
| 411 | 0.32 | V411R | 0.27 | V411N | 0.21 | V411Q | 0.19 | V411T | 0.14 |
|  | 0.09 | V411S | 0.08 | V411G | 0.06 | V411K | 0.03 | V411E | 0.02 |
| 418 | 0.91 | R418D | 0.89 | R418I | 0.83 | R418V | 0.78 | R418N | 0.76 |
|  | 0.58 | R418Q | 0.58 | R418W | 0.54 | R418F | 0.43 | R418C | 0.36 |
| 420 | 1.00 | N420G | 0.98 | N420L | 0.91 | N420F | 0.90 | N420W | 0.89 |
|  | 0.68 | N420H | 0.68 | N420R | 0.68 | N420Q | 0.65 | N420S | 0.63 |
| 422 | 1.01 | R422T | 0.92 | R422K | 0.91 | R422L | 0.87 | R422V | 0.84 |
|  | 0.72 | R422G | 0.67 | R422H | 0.66 | R422C | 0.63 | R422E | 0.60 |
| 425 | 1.15 | L425F | 1.08 | L425R | 1.04 | L425S | 1.00 | L425K | 0.96 |
|  | 0.92 | L425H | 0.89 | L425T | 0.84 | L425E | 0.83 | L425C | 0.67 |
| 426 | 1.01 | N426A | 0.99 | N426V | 0.91 | N426K | 0.83 | N426L | 0.83 |
|  | 0.68 | N426F | 0.59 | N426K | 0.59 | N426I | 0.53 | N426H | 0.51 |
| 427 | 1.12 | S427W | 1.10 | S427T | 1.10 | S427G | 1.03 | S427L | 0.97 |
|  | 0.78 | S427K | 0.74 | S427A | 0.73 | S427C | 0.68 | S427D | 0.55 |
| 428 | 0.96 | L428T | 0.92 | L428M | 0.85 | L428H | 0.83 | L428R | 0.82 |
|  | 0.73 | L428E | 0.72 | L428D | 0.65 | L428Y | 0.63 | L428I | 0.60 |
| 429 | 1.08 | R429K | 1.00 | R429M | 0.99 | R429F | 0.91 | R429A | 0.89 |
|  | 0.79 | R429V | 0.73 | R429P | 0.72 | R429E | 0.65 | R429D | 0.63 |
| 431 | 0.87 | S431E | 0.87 | S431Y | 0.86 | S431Q | 0.86 | S431F | 0.82 |
|  | 0.71 | S431P | 0.61 | S431D | 0.60 | S431C | 0.32 |  |  |
| 435 | 0.90 | T435K | 0.88 | T435Q | 0.82 | T435V | 0.79 | T435S | 0.58 |
|  | 0.52 | T435R | 0.47 | T435C | 0.24 | T435G | 0.20 | T435P | 0.04 |
| 437 | 0.95 | G437H | 0.94 | G437V | 0.88 | G437W | 0.88 | G437L | 0.84 |
|  | 0.36 | G437C | 0.26 |  |  |  |  |  |  |
| 439 | 1.15 | T439H | 1.08 | T439N | 0.99 | T439Y | 0.92 | T439I | 0.89 |
|  | 0.67 | T439D | 0.64 | T439E | 0.58 | T439W | 0.54 | T439C | 0.17 |
| 444 | 0.58 | Q444T | 0.53 | Q444L | 0.48 | Q444S | 0.48 | Q444V | 0.47 |
|  | 0.28 | Q444Y | 0.26 | Q444W | 0.24 | Q444I | 0.18 | Q444G | 0.12 |
| 447 | 0.94 | D447F | 0.94 | D447H | 0.94 | D447T | 0.88 | D447W | 0.78 |

TABLE 5-continued

| | | | | | | | | | |
|---|---|---|---|---|---|---|---|---|---|
| 473 | 1.02 | | | | | | | | |
| 476 | 0.84 | I476R | 0.59 | I476D | 0.40 | I476A | 0.29 | | |
| 477 | 0.53 | G477H | 0.42 | G477M | 0.41 | G477E | 0.33 | G477F | 0.25 |
| 478 | 1.04 | N478L | 0.88 | N478V | 0.82 | N478M | 0.68 | N478I | 0.59 |
| 479 | 0.75 | T479A | 0.66 | T479N | 0.50 | T479Q | 0.44 | T479Y | 0.40 |
| | 0.19 | T479W | 0.18 | | | | | | |
| 481 | 0.23 | R481N | 0.18 | R481T | 0.18 | R481D | 0.15 | R481F | 0.14 |
| | 0.04 | | | | | | | | |
| 492 | 0.38 | | | | | | | | |
| 498 | 0.65 | I498W | 0.47 | I498M | 0.43 | I498Y | 0.37 | I498A | 0.28 |
| 499 | | | | | | | | | |
| 503 | | | | | | | | | |
| 504 | 0.60 | T504Q | 0.52 | | | | | | |
| 505 | 0.20 | | | | | | | | |
| 506 | 0.11 | | | | | | | | |
| 507 | | | | | | | | | |
| 508 | 0.23 | | | | | | | | |
| 509 | 0.83 | V509S | 0.72 | V509A | 0.67 | V509W | 0.57 | V509M | 0.55 |
| 511 | | | | | | | | | |
| 512 | 1.05 | N512T | 1.04 | N512F | 0.96 | N512A | 0.82 | | |
| 513 | 0.75 | | | | | | | | |
| 514 | | | | | | | | | |
| 515 | 0.53 | F515Q | 0.51 | F515K | 0.50 | F515T | 0.45 | F515A | 0.44 |
| 517 | | | | | | | | | |
| 520 | | | | | | | | | |
| 525 | 0.72 | F525C | 0.60 | F525A | 0.40 | F525G | 0.39 | | |
| 526 | 0.24 | | | | | | | | |
| 527 | | | | | | | | | |
| 530 | 0.52 | S536N | 0.41 | L530G | 0.31 | L530S | 0.27 | L530E | 0.22 |
| 531 | | | | | | | | | |
| 533 | 0.21 | | | | | | | | |
| 534 | 0.86 | N534T | 0.81 | | | | | | |
| 535 | | | | | | | | | |
| 536 | 0.83 | S536Q | 0.66 | S536C | 0.62 | S536M | 0.60 | S536H | 0.56 |
| | 0.35 | S536E | 0.30 | S536P | 0.27 | S536K | 0.21 | S536V | 0.20 |
| 537 | 0.95 | G537P | 0.57 | | | | | | |
| 538 | | | | | | | | | |
| 539 | 0.79 | N539E | 0.77 | N539L | 0.72 | N539A | 0.60 | N539F | 0.57 |
| | 0.49 | N539W | 0.43 | N539Y | 0.39 | N539R | 0.18 | N539K | 0.17 |
| 540 | 0.84 | I540L | 0.82 | I540G | 0.51 | I540C | 0.50 | I540R | 0.17 |
| 541 | 0.54 | Q541E | 0.39 | Q541C | 0.37 | Q541T | 0.30 | Q541L | 0.30 |
| 542 | 0.64 | N542Y | 0.63 | N542H | 0.61 | N542T | 0.53 | N542C | 0.52 |
| | 0.24 | N542P | 0.05 | | | | | | |
| 543 | 0.06 | R543M | 0.0587 | R543L | 0.0419 | R543K | 0.0394 | R543S | 0.033 |
| | 0.0079 | R543P | 0.0079 | R543D | 0.002 | R543T | 0.0011 | R543E | 0.0002 |
| 545 | 0.26 | Y545H | 0.26 | Y545N | 0.25 | Y545W | 0.24 | Y545T | 0.21 |
| | 0.08 | Y545I | 0.07 | Y545Q | 0.07 | Y545E | 0.06 | Y545P | 0.04 |
| 546 | 0.80 | I546S | 0.32 | I546G | 0.23 | | | | |
| 547 | 0.94 | E547T | 0.85 | E547H | 0.78 | E547P | 0.75 | E547L | 0.58 |
| | 0.27 | | | | | | | | |
| 548 | 0.45 | V548W | 0.26 | | | | | | |
| 549 | 0.75 | P549R | 1.03 | P549M | 0.55 | P549L | 0.86 | P549G | 1.73 |
| 550 | 0.45 | | | | | | | | |
| 551 | 1.01 | Q551E | 0.93 | Q551N | 0.87 | Q551L | 0.85 | | |
| 552 | 0.98 | F552Q | 0.80 | F552R | 0.51 | | | | |
| 553 | | | | | | | | | |
| 554 | | | | | | | | | |
| 555 | 0.78 | T555L | 0.27 | | | | | | |
| 557 | | | | | | | | | |
| 558 | | | | | | | | | |
| 559 | 0.47 | Y559E | 0.43 | Y559T | 0.27 | Y559S | 0.17 | Y559D | 0.10 |
| 563 | 0.54 | V563E | 0.05 | | | | | | |
| 564 | 0.20 | | | | | | | | |
| 568 | | | | | | | | | |
| 569 | 1.10 | T569W | 1.02 | T569K | 0.82 | T569A | 0.58 | T569Y | 0.35 |
| 570 | 1.07 | P570V | 1.06 | P570H | 1.05 | P570R | 1.03 | P570I | 1.03 |
| | 0.70 | P570D | 0.52 | P570L | 0.47 | | | | |
| 571 | | | | | | | | | |
| 572 | 0.87 | Q572E | 0.75 | Q572D | 0.75 | Q572C | 0.57 | | |
| 574 | 0.64 | S574Q | 0.64 | S574F | 0.56 | S574Y | 0.56 | S574A | 0.53 |
| | 0.29 | S574C | 0.29 | S574D | 0.26 | | | | |
| 577 | 1.04 | W577P | 0.97 | W577D | 0.92 | W577E | 0.81 | | |
| 581 | 0.90 | N581V | 0.86 | N581H | 0.70 | N581Y | 0.64 | N581M | 0.63 |
| | 0.46 | N581A | 0.42 | N581L | 0.32 | N581D | 0.29 | N581C | 0.13 |
| 584 | 0.90 | S584V | 0.81 | S584C | 0.78 | S584N | 0.67 | S584Y | 0.66 |
| | 0.59 | S584I | 0.54 | S584M | 0.41 | S584W | 0.38 | S584D | 0.31 |
| 585 | 0.79 | S585A | 0.74 | S585D | 0.67 | S585C | 0.60 | S585V | 0.47 |
| 590 | 0.72 | T590L | 0.54 | T590R | 0.53 | T590E | 0.52 | T590P | 0.15 |
| 591 | | | | | | | | | |
| 592 | | | | | | | | | |

TABLE 5-continued

| | | | | | | | | | |
|---|---|---|---|---|---|---|---|---|---|
| 593 | 1.06 | S593T | 1.00 | S593M | 0.96 | S593H | 0.92 | S593D | 0.89 |
| | 0.79 | S593N | 0.75 | S593P | 0.75 | S593C | 0.59 | | |
| 595 | 0.91 | D595E | 0.09 | | | | | | |
| 596 | 0.98 | N596E | 0.93 | N596R | 0.92 | N596K | 0.92 | | |
| 598 | 0.95 | Q598L | 0.92 | Q598E | 0.89 | Q598W | 0.88 | Q598N | 0.83 |
| | 0.60 | Q598K | 0.58 | Q598S | 0.58 | Q598C | 0.55 | | |
| 599 | 0.81 | S599E | 0.61 | | | | | | |
| 600 | 0.74 | R600E | 0.70 | R600T | 0.69 | R600K | 0.69 | R600F | 0.66 |
| | 0.56 | R600C | 0.54 | R600L | 0.54 | R600P | 0.47 | R600N | 0.45 |
| 601 | 0.96 | N601S | 0.81 | N601H | 0.79 | N601L | 0.78 | N601K | 0.76 |
| | 0.58 | | | | | | | | |
| 602 | 0.59 | | | | | | | | |
| 605 | | | | | | | | | |
| 606 | 0.85 | E606P | 0.39 | | | | | | |
| 607 | 1.01 | S607W | 1.01 | S607Y | 0.90 | S607P | 0.86 | S607F | 0.83 |
| 608 | 0.98 | T608P | 0.68 | T608I | 0.53 | T608C | 0.53 | T608N | 0.50 |
| 609 | | | | | | | | | |
| 612 | 0.86 | T612W | 0.84 | T612I | 0.53 | | | | |
| 613 | | | | | | | | | |
| 614 | | | | | | | | | |
| 617 | | | | | | | | | |
| 618 | 1.10 | V618P | 1.07 | V618E | 1.05 | V618K | 1.03 | V618I | 0.94 |
| 620 | 0.25 | G620F | 0.23 | G620K | 0.23 | G620V | 0.23 | G620Q | 0.22 |
| 622 | 0.09 | | | | | | | | |
| 623 | 0.85 | N623C | 0.70 | N623V | 0.68 | N623T | 0.65 | N623Q | 0.61 |
| 624 | 0.73 | F624D | 0.68 | F624C | 0.59 | F624H | 0.56 | F624R | 0.44 |
| 626 | 0.66 | E626M | 0.08 | | | | | | |
| 628 | | | | | | | | | |
| 629 | 1.07 | G629V | 1.05 | G629K | 1.03 | G629D | 0.87 | G629W | 0.86 |
| 630 | 0.76 | V630R | 0.66 | V630D | 0.64 | V630S | 0.55 | | |
| 641 | | | | | | | | | |
| 643 | 0.70 | | | | | | | | |
| 645 | | | | | | | | | |
| 646 | | | | | | | | | |

Example 5—Transient Expression in Maize Leaves and Insect Bioassay

Polynucleotides encoding the variant Cry1B polypeptides were cloned into transient expression vectors under control of the maize ubiquitin promoter (Christensen and Quail, (1996) Transgenic Research 5:213-218) and a duplicated version of the promoter from the *mirabilis* mosaic virus (DMMV PRO; Dey and Maiti, (1999) Plant Mol. Biol., 40:771-82). The agro-infiltration method of introducing an *Agrobacterium* cell suspension to plant cells of intact tissues so that reproducible infection and subsequent plant derived transgene expression may be measured or studied is well known in the art (Kapila, et. al., (1997) Plant Science 122:101-108). Briefly, young plantlets of maize were agro-infiltrated with normalized bacterial cell cultures of test and control strains. Leaf discs were generated from each plantlet and infested with WCRW (*Diabrotica virgifera*) along with appropriate controls. The degree of consumption of green leaf tissues was scored after 2 days of infestation.

Example 6—Transient Expression in Bush Bean Leaves and Insect Bioassay

For soybean expression optimized coding sequences can be designed. The agro-infiltration method of introducing an *Agrobacterium* cell suspension to plant cells of intact tissues so that reproducible infection and subsequent plant derived transgene expression may be measured or studied is well known in the art (Kapila, et. al., (1997) *Plant Science* 122:101-108). Briefly, excised leaf disks of bush bean, are agro-infiltrated with normalized bacterial cell cultures of test and control strains. After 4 days leaf disks are infested with 2 neonates of Soybean Looper (SBL) (*Chrysodeixis includens*), Corn Earworm, (CEW) (*Helicoverpa zea*), Velvetbean Caterpillar (VBC) (*Anticarsia gemmatalis*), or Fall Armyworm (*Spodoptera frugiperda*) alone. Control leaf discs are generated with *Agrobacterium* containing only a DsRed2 fluorescence marker (Clontech™, 1290 Terra Bella Ave. Mountain View, Calif. 94043) expression vector. Leaf discs from non-infiltrated plants are included as a second control. The consumption of green leaf tissue is scored three days after infestation and given scores of 0 to 9.

Example 7—*Agrobacterium*-Mediated Transformation of Maize and Regeneration of Transgenic Plants For *Agrobacterium*-mediated transformation of maize with a polynucleotide sequence of the disclosure, the method of Zhao can be used (U.S. Pat. No. 5,981,840 and PCT patent publication WO98/32326; the contents of which are hereby incorporated by reference). Briefly, immature embryos are isolated from maize and the embryos contacted with a suspension of *Agrobacterium* under conditions whereby the bacteria are capable of transferring the toxin nucleotide sequence to at least one cell of at least one of the immature embryos (step 1: the infection step). In this step the immature embryos can be immersed in an *Agrobacterium* suspension for the initiation of inoculation. The embryos are co-cultured for a time with the *Agrobacterium* (step 2: the co-cultivation step). The immature embryos can be cultured on solid medium following the infection step. Following this co-cultivation period an optional "resting" step is contemplated. In this resting step, the embryos are incubated in the presence of at least one antibiotic known to inhibit the growth of *Agrobacterium* without the addition of a selective agent for plant transformants (step 3: resting step). The immature embryos can be cultured on solid medium with antibiotic, but without a selecting agent, for elimination of *Agrobacterium* and for a resting phase for the infected cells. Next, inoculated embryos are cultured on medium containing a selective agent and growing transformed callus is recovered (step 4: the selection step). The immature embryos are cultured on solid medium with a selective agent resulting in the selective growth of transformed cells. The callus is then regenerated into plants (step 5: the regeneration step), and calli grown on selective medium can be cultured on solid medium to regenerate the plants.

Example 8—Transformation of Soybean Embryos

Soybean embryos are bombarded with a plasmid containing the toxin nucleotide sequence operably linked to a suitable promoter as follows. To induce somatic embryos, cotyledons, 3-5 mm in length dissected from surface-sterilized, immature seeds of an appropriate soybean cultivar are cultured in the light or dark at 26° C. on an appropriate agar medium for six to ten weeks. Somatic embryos producing secondary embryos are then excised and placed into a suitable liquid medium. After repeated selection for clusters of somatic embryos that multiplied as early, globular-staged embryos, the suspensions are maintained as described below.

Soybean embryogenic suspension cultures can be maintained in 35 mL liquid media on a rotary shaker, 150 rpm, at 26° C. with florescent lights on a 16:8 hour day/night schedule. Cultures are subcultured every two weeks by inoculating approximately 35 mg of tissue into 35 mL of liquid medium.

Soybean embryogenic suspension cultures may then be transformed by the method of particle gun bombardment (Klein, et al., (1987) Nature (London) 327:70-73, U.S. Pat. No. 4,945,050). A DuPont Biolistic PDS1000/HE instrument (helium retrofit) can be used for these transformations.

A selectable marker gene that can be used to facilitate soybean transformation includes, but is not limited to: the 35S promoter from Cauliflower Mosaic Virus (Odell, et al., (1985) Nature 313:810-812), the hygromycin phosphotransferase gene from plasmid pJR225 (from *E. coli*; Gritz, et al., (1983) Gene 25:179-188), and the 3' region of the nopaline synthase gene from the T DNA of the Ti plasmid of *Agrobacterium tumefaciens*. The expression cassette comprising a toxin nucleotide sequence (e.g., SEQ ID NO: 1, SEQ ID NO: 3 or a maize optimized sequence) operably linked to a suitable promoter can be isolated as a restriction fragment. This fragment can then be inserted into a unique restriction site of the vector carrying the marker gene.

To 50 μL of a 60 mg/mL 1 μm gold particle suspension is added (in order): 5 μL DNA (1 μg/μL), 20 μL spermidine (0.1M), and 50 μL CaCl$_2$) (2.5M). The particle preparation is then agitated for three minutes, spun in a microfuge for 10 seconds and the supernatant removed. The DNA-coated particles are then washed once in 400 μL 70% ethanol and resuspended in 40 μL of anhydrous ethanol. The DNA/particle suspension can be sonicated three times for one second each. Five microliters of the DNA-coated gold particles are then loaded on each macro carrier disk.

Approximately 300-400 mg of a two-week-old suspension culture is placed in an empty 60×15 mm petri dish and the residual liquid removed from the tissue with a pipette. For each transformation experiment, approximately 5-10 plates of tissue are normally bombarded. Membrane rupture pressure is set at 1100 psi, and the chamber is evacuated to a vacuum of 28 inches mercury. The tissue is placed approximately 3.5 inches away from the retaining screen and bombarded three times. Following bombardment, the tissue can be divided in half and placed back into liquid and cultured as described above.

Five to seven days post bombardment the liquid media may be exchanged with fresh media, and eleven to twelve days post-bombardment with fresh media containing 50 mg/mL hygromycin. This selective media can be refreshed weekly. Seven to eight weeks post-bombardment, green, transformed tissue may be observed growing from untransformed, necrotic embryogenic clusters. Isolated green tissue is removed and inoculated into individual flasks to generate new, clonally propagated, transformed embryogenic suspension cultures. Each new line may be treated as an independent transformation event. These suspensions can then be subcultured and maintained as clusters of immature embryos or regenerated into whole plants by maturation and germination of individual somatic embryos.

Example 9—Generation of Cry1B Variants with Improved Spectrum of Insecticidal Activity A series of additional Cry1B variant polypeptides derived from IP1B-B45 (SEQ ID NO: 41) were designed to introduce additional amino acid substitutions into Domain I or Domain III, which were found in Example 4 (Table 4) to result in increased insecticidal activity against corn earworm, to further improve the insecticidal activity against corn earworm (CEW) compared to IP1B-B45 (SEQ ID NO: 41). The clone identifier, sequence identifier, and the IC50 fold improvement in insecticidal activity against corn earworm for selected variants having amino acid substitutions in Domain III are shown in Table 6.

TABLE 6

| Clone ID | Polypeptide Sequence | fold improvement over Cry1Bd |
|---|---|---|
| IP1B-B60 | SEQ ID NO: 62 | 123 |
| IP1B-B61 | SEQ ID NO: 63 | 93 |
| IP1B-B62 | SEQ ID NO: 64 | 93 |
| IP1B-B63 | SEQ ID NO: 65 | 105 |
| IP1B-B64 | SEQ ID NO: 66 | 109 |
| IP1B-B65 | SEQ ID NO: 67 | 232 |
| IP1B-B66 | SEQ ID NO: 68 | 200 |
| IP1B-B67 | SEQ ID NO: 69 | 168 |
| IP1B-B68 | SEQ ID NO: 70 | 296 |
| IP1B-B69 | SEQ ID NO: 71 | 232 |
| IP1B-B80 | SEQ ID NO: 72 | 160 |
| IP1B-B81 | SEQ ID NO: 73 | 200 |
| IP1B-B82 | SEQ ID NO: 74 | 194 |
| IP1B-B83 | SEQ ID NO: 75 | 178 |
| S59-01 | SEQ ID NO: 79 | 81 |
| S59-03 | SEQ ID NO: 80 | 96 |
| S59-04 | SEQ ID NO: 81 | 96 |
| S59-06 | SEQ ID NO: 82 | 88 |
| S59-07 | SEQ ID NO: 83 | 82 |
| S59-08 | SEQ ID NO: 84 | 75 |
| S59-09 | SEQ ID NO: 85 | 82 |
| S59-10 | SEQ ID NO: 86 | 91 |
| S62-12 | SEQ ID NO: 87 | 120 |
| S62-14 | SEQ ID NO: 88 | 128 |
| S62-16 | SEQ ID NO: 89 | 136 |
| S62-18 | SEQ ID NO: 90 | 104 |
| S62-21 | SEQ ID NO: 91 | 128 |
| S65-1 | SEQ ID NO: 92 | 126 |
| S65-12 | SEQ ID NO: 93 | 119 |
| S65-2 | SEQ ID NO: 94 | 106 |
| S65-3 | SEQ ID NO: 95 | 105 |
| S65-4 | SEQ ID NO: 96 | 138 |
| S65-6 | SEQ ID NO: 97 | 143 |

The clone identifier, sequence identifier, and the IC50 fold improvement in insecticidal activity against corn earworm for selected variants having amino acid substitutions in Domain I are shown in Table 7.

TABLE 7

| Clone ID | Polypeptide Sequence | Fold-improvement over Cry1Bd |
|---|---|---|
| SL3-01 | SEQ ID NO: 98 | 9 |
| SL3-02 | SEQ ID NO: 99 | 84 |
| SL3-03 | SEQ ID NO: 100 | 74 |
| SL3-04 | SEQ ID NO: 101 | 71 |
| SL3-05 | SEQ ID NO: 102 | 99 |
| SL3-06 | SEQ ID NO: 103 | 93 |
| SL3-07 | SEQ ID NO: 104 | 74 |
| SL3-08 | SEQ ID NO: 105 | 91 |
| SL3-09 | SEQ ID NO: 106 | 86 |
| SL3-10 | SEQ ID NO: 107 | 85 |
| SL3-11 | SEQ ID NO: 108 | 31 |
| SL3-12 | SEQ ID NO: 109 | 109 |
| SL3-13 | SEQ ID NO: 110 | 87 |
| SL3-14 | SEQ ID NO: 111 | 113 |
| SL3-15 | SEQ ID NO: 112 | 67 |
| SL3-16 | SEQ ID NO: 113 | 93 |
| SL3-17 | SEQ ID NO: 114 | 112 |
| SL3-18 | SEQ ID NO: 115 | 102 |
| SL3-19 | SEQ ID NO: 116 | 76 |
| SL4-1 | SEQ ID NO: 117 | 266 |
| SL4-2 | SEQ ID NO: 118 | 325 |
| SL4-3 | SEQ ID NO: 119 | >320 |
| SL4-5 | SEQ ID NO: 120 | >320 |
| SL4-6 | SEQ ID NO: 121 | 352 |
| SL4-7 | SEQ ID NO: 122 | 713 |
| SL6-01 | SEQ ID NO: 123 | 100 |
| SL6-02 | SEQ ID NO: 124 | 92 |
| SL6-03 | SEQ ID NO: 125 | 69 |
| SL6-04 | SEQ ID NO: 126 | 82 |
| SL6-05 | SEQ ID NO: 127 | 75 |
| SL6-06 | SEQ ID NO: 128 | 80 |
| SL6-07 | SEQ ID NO: 129 | 81 |
| SL6-08 | SEQ ID NO: 130 | 86 |
| SL6-09 | SEQ ID NO: 131 | 105 |
| SL6-10 | SEQ ID NO: 132 | 58 |
| SL6-11 | SEQ ID NO: 133 | 95 |
| SL6-12 | SEQ ID NO: 134 | 432 |
| SL6-13 | SEQ ID NO: 135 | 97 |
| SL6-14 | SEQ ID NO: 136 | 95 |
| SL6-15 | SEQ ID NO: 137 | 162 |
| SL6-16 | SEQ ID NO: 138 | 77 |
| SL7-1 | SEQ ID NO: 139 | 97 |
| SL7-5 | SEQ ID NO: 140 | 117 |
| SL7-6 | SEQ ID NO: 141 | 108 |
| SL7-7 | SEQ ID NO: 142 | 96 |
| SL8-02 | SEQ ID NO: 143 | 130 |
| SL8-03 | SEQ ID NO: 144 | 102 |

The insecticidal activity of the Cry1B variants was determined as described in Example 4. Particular variants, indicated in Table 8, having at least 2-fold increased activity (IC50) compared to MP258 (SEQ ID NO: 47) were selected for further analysis. The clone identifier, sequence identifier, and the amino acid substitutions compared to IP1B-B45 (SEQ ID NO: 41) are shown in Table 8.

TABLE 8

| Clone ID | polypeptide | 362 | 518 | 553 | 595 | 596 | 606 | 645 | 646 |
|---|---|---|---|---|---|---|---|---|---|
| IP1B-B45 | SEQ ID NO: 41 | N | S | I | D | N | E | E | A |
| IP1B-B60 | SEQ ID NO: 62 | Y | L | I | D | N | E | E | A |
| IP1B-B61 | SEQ ID NO: 63 | N | L | R | D | N | E | E | A |
| IP1B-B62 | SEQ ID NO: 64 | N | L | I | D | N | E | L | A |
| IP1B-B63 | SEQ ID NO: 65 | N | L | I | D | N | E | T | A |
| IP1B-B64 | SEQ ID NO: 66 | N | L | I | D | N | E | E | H |
| IP1B-B65 | SEQ ID NO: 67 | Y | L | I | S | N | H | E | A |
| IP1B-B66 | SEQ ID NO: 68 | Y | L | I | S | N | Q | E | A |
| IP1B-B67 | SEQ ID NO: 69 | Y | L | I | S | T | H | E | A |
| IP1B-B68 | SEQ ID NO: 70 | Y | L | I | S | V | E | E | A |
| IP1B-B69 | SEQ ID NO: 71 | Y | L | I | S | V | Q | E | A |
| IP1B-B80 | SEQ ID NO: 72 | Y | L | I | D | T | Q | E | A |
| IP1B-B81 | SEQ ID NO: 73 | Y | L | I | D | V | H | E | A |
| IP1B-B82 | SEQ ID NO: 74 | N | L | R | D | T | H | E | A |
| IP1B-B83 | SEQ ID NO: 75 | N | L | R | D | V | H | E | A |

A series of Cry1B variant polypeptides derived from IP1B-B64 (SEQ ID NO: 66) were designed to introduce additional amino acid substitutions in Domain I to further improve the insecticidal activity against corn earworm (CEW) compared to IP1B-B64 (SEQ ID NO: 66). Variant Cry1B polypeptides having improved insecticidal activity (IC50 fold improvement) that were generated include those indicated in Table 9. The insecticidal activity of the Cry1B variants was determined as described in Example 4 and the insecticidal activity results are shown in Table 9. The clone identifier, sequence identifier, and the amino acid substitutions compared to IP1B-B64 (SEQ ID NO: 66) are shown in Table 10.

An amino acid sequence alignment of selected variant Cry1B polypeptides is shown in FIG. 6.

TABLE 9

| Clone ID | | Fold-improvement over Cry1Bd |
|---|---|---|
| IP1B-B100 | SEQ ID NO: 76 | 149 |
| IP1B-B101 | SEQ ID NO: 77 | 179 |
| IP1B-B102 | SEQ ID NO: 78 | 169 |

TABLE 10

| | | 112 | 114 | 210 | 245 |
|---|---|---|---|---|---|
| IP1B-B64 | SEQ ID NO: 66 | I | M | S | T |
| IP1B-B100 | SEQ ID NO: 76 | L | Y | S | T |
| IP1B-B101 | SEQ ID NO: 77 | I | Y | R | T |
| IP1B-B102 | SEQ ID NO: 78 | I | Y | S | H |

An amino acid sequence alignment of selected variant Cry1B polypeptides is shown in FIG. 6.

The percent amino acid sequence identity of the Cry1B variant polypeptides, of Table 8 and Table 10, calculated using the Needleman-Wunsch algorithm as implemented in the Needle program (EMBOSS tool suite), are shown as a matrix table in Table 11.

TABLE 11

| | IP1B-B100 SEQ ID NO: 76 | IP1B-B101 SEQ ID NO: 77 | IP1B-B102 SEQ ID NO: 76 | IP1B-B60 SEQ ID NO: 62 | IP1B-B61 SEQ ID NO: 63 | IP1B-B62 SEQ ID NO: 64 | IP1B-B63 SEQ ID NO: 65 | IP1B-B64 SEQ ID NO: 66 | IP1B-B65 SEQ ID NO: 67 |
|---|---|---|---|---|---|---|---|---|---|
| IP1B-B45 SEQ ID NO: 45 | 99.4 | 99.4 | 99.4 | 99.7 | 99.7 | 99.7 | 99.7 | 99.7 | 99.4 |
| IP1B-B100 SEQ ID NO: 76 | — | 99.7 | 99.7 | 99.4 | 99.4 | 99.4 | 99.4 | 99.7 | 99.1 |

TABLE 11-continued

| | | | | | | | | | |
|---|---|---|---|---|---|---|---|---|---|
| IP1B-B101 SEQ ID NO: 77 | — | — | 99.7 | 99.4 | 99.4 | 99.4 | 99.4 | 99.7 | 99.1 |
| IP1B-B102 SEQ ID NO: 78 | — | — | — | 99.4 | 99.4 | 99.4 | 99.4 | 99.7 | 99.1 |
| IP1B-B60 SEQ ID NO: 62 | — | — | — | — | 99.7 | 99.7 | 99.7 | 99.7 | 99.7 |
| IP1B-B61 SEQ ID NO: 63 | — | — | — | — | — | 99.7 | 99.7 | 99.7 | 99.4 |
| IP1B-B62 SEQ ID NO: 64 | — | — | — | — | — | — | 99.8 | 99.7 | 99.4 |
| IP1B-B63 SEQ ID NO: 65 | — | — | — | — | — | — | — | 99.7 | 99.4 |
| IP1B-B64 SEQ ID NO: 66 | — | — | — | — | — | — | — | — | 99.4 |
| IP1B-B65 SEQ ID NO: 67 | — | — | — | — | — | — | — | — | — |
| IP1B-B66 SEQ ID NO: 68 | — | — | — | — | — | — | — | — | — |
| IP1B-B67 SEQ ID NO: 69 | — | — | — | — | — | — | — | — | — |
| IP1B-B68 SEQ ID NO: 70 | — | — | — | — | — | — | — | — | — |
| IP1B-B69 SEQ ID NO: 71 | — | — | — | — | — | — | — | — | — |
| IP1B-B80 SEQ ID NO: 72 | — | — | — | — | — | — | — | — | — |
| IP1B-B81 SEQ ID NO: 73 | — | — | — | — | — | — | — | — | — |
| IP1B-B82 SEQ ID NO: 74 | — | — | — | — | — | — | — | — | — |

| | IP1B-B66 SEQ ID NO: 68 | IP1B-B67 SEQ ID NO: 69 | IP1B-B68 SEQ ID NO: 70 | IP1B-B69 SEQ ID NO: 71 | IP1B-B80 SEQ ID NO: 72 | IP1B-B81 SEQ ID NO: 73 | IP1B-B82 SEQ ID NO: 74 | IP1B-B83 SEQ ID NO: 75 |
|---|---|---|---|---|---|---|---|---|
| IP1B-B45 SEQ ID NO: 45 | 99.4 | 99.2 | 99.4 | 99.2 | 99.4 | 99.4 | 99.4 | 99.4 |
| IP1B-B100 SEQ ID NO: 76 | 99.1 | 98.9 | 99.1 | 98.9 | 99.1 | 99.1 | 99.1 | 99.1 |
| IP1B-B101 SEQ ID NO: 77 | 99.1 | 98.9 | 99.1 | 98.9 | 99.1 | 99.1 | 99.1 | 99.1 |
| IP1B-B102 SEQ ID NO: 78 | 99.1 | 98.9 | 99.1 | 98.9 | 99.1 | 99.1 | 99.1 | 99.1 |
| IP1B-B60 SEQ ID NO: 62 | 99.7 | 99.5 | 99.7 | 99.5 | 99.7 | 99.7 | 99.4 | 99.4 |
| IP1B-B61 SEQ ID NO: 63 | 99.4 | 99.2 | 99.4 | 99.2 | 99.4 | 99.4 | 99.7 | 99.7 |
| IP1B-B62 SEQ ID NO: 64 | 99.4 | 99.2 | 99.4 | 99.2 | 99.4 | 99.4 | 99.4 | 99.4 |
| IP1B-B63 SEQ ID NO: 65 | 99.4 | 99.2 | 99.4 | 99.2 | 99.4 | 99.4 | 99.4 | 99.4 |
| IP1B-B64 SEQ ID NO: 66 | 99.4 | 99.2 | 99.4 | 99.2 | 99.4 | 99.4 | 99.4 | 99.4 |
| IP1B-B65 SEQ ID NO: 67 | 99.8 | 99.8 | 99.7 | 99.7 | 99.5 | 99.7 | 99.4 | 99.4 |
| IP1B-B66 SEQ ID NO: 68 | — | 99.7 | 99.7 | 99.8 | 99.7 | 99.5 | 99.2 | 99.2 |
| IP1B-B67 SEQ ID NO: 69 | — | — | 99.7 | 99.7 | 99.7 | 99.7 | 99.5 | 99.4 |
| IP1B-B68 SEQ ID NO: 70 | — | — | — | 99.8 | 99.5 | 99.7 | 99.2 | 99.4 |
| IP1B-B69 SEQ ID NO: 71 | — | — | — | — | 99.7 | 99.7 | 99.2 | 99.4 |
| IP1B-B80 SEQ ID NO: 72 | — | — | — | — | — | 99.7 | 99.5 | 99.4 |
| IP1B-B81 SEQ ID NO: 73 | — | — | — | — | — | — | 99.5 | 99.7 |
| IP1B-B82 SEQ ID NO: 74 | — | — | — | — | — | — | — | 99.8 |

Example 10—Generation of MP258/Cry1Bd Domain I Chimeras

MP258/Cry1Bd chimeras were designed to exchange either Domain I or Domain II of Cry1Bd (SEQ ID NO: 1) for the corresponding Domain I or Domain II of MP258 (SEQ ID NO: 47). The clone identifier, sequence identifier, respective Domain I, Domain II and Domain III, and the insecticidal activity against corn earworm, for the resulting chimeras are shown in Table 12. A sequence alignment of Cry1Bd (SEQ ID NO: 1), MP258 (SEQ ID NO: 47), and the Cry1Bd/MP258 chimeras MO2-01 (SEQ ID NO: 145) and MO2-02 (SEQ ID NO: 146) is shown on FIG. 7.

TABLE 12

| Identifier | Domain I | Domain II | Domain III | IC50 (ppm) | LC50 (ppm) |
|---|---|---|---|---|---|
| MO2-1 (SEQ ID NO: 145) | Cry1Bd | MP258 | MP258 | 37.6 | n.d. |
| MO2-2 (SEQ ID NO: 146) | MP258 | Cry1Bd | MP258 | 7.5 | 44.8 |

Based on the above results, a series of additional Cry1B variant polypeptides were designed to introduce the alpha-helices of Domain I of MP258 (SEQ ID NO: 47) into Cry1Bd (SEQ ID NO: 1) or the alpha-helices Domain I of Cry1Bd (SEQ ID NO: 1) into MP258 (SEQ ID NO: 47). The clone identifier, sequence identifier, and insecticidal activity against corn earworm, for selected variants having alpha-helices exchanges in Domain I, are shown in Table 13. Amino acid sequence alignments of the chimeric Cry1B polypeptides are shown in FIGS. 8 and 9.

TABLE 13

| Identifier | Backbone | MP258 Domain I αhelices 1 | 2 | 3 | Cry1Bd Domain I α-helices 1 | 2 | 3 | IC50 (ppm) | LC50 (ppm) |
|---|---|---|---|---|---|---|---|---|---|
| MO4-02 (SEQ ID NO: 149) | Cry1Bd | ✓ | | | | | | | |
| MO4-03 (SEQ ID NO: 150) | | | ✓ | | | | | | |
| MO4-05 (SEQ ID NO: 152) | | ✓ | ✓ | | | | | | |
| MO4-01 (SEQ ID NO: 147) | | ✓ | ✓ | ✓ | | | | 9.1 | 568 |
| MO4-06 (SEQ ID NO: 153) | | | ✓ | ✓ | | | | | |
| MO4-04 (SEQ ID NO: 151) | | | | ✓ | | | | | |
| MO4-07 (SEQ ID NO: 154) | | ✓ | | ✓ | | | | | |
| MO5-02 (SEQ ID NO: 155) | MP258 | | | | | ✓ | | | |
| MO5-03 (SEQ ID NO: 156) | | | | | | | ✓ | | |
| MO5-05 (SEQ ID NO: 158) | | | | | | ✓ | ✓ | | |
| MO5-04 (SEQ ID NO: 157) | | | | | | | | ✓ | |
| MO5-07 (SEQ ID NO: 160) | | | | | | ✓ | ✓ | | |
| MO5-01 (SEQ ID NO: 148) | | | | | ✓ | ✓ | ✓ | 6.3 | 222 |
| MO5-06 (SEQ ID NO: 159) | | | | | | ✓ | ✓ | | |

All publications, patents and patent applications mentioned in the specification are indicative of the level of those skilled in the art to which this disclosure pertains. All publications, patents and patent applications are herein incorporated by reference to the same extent as if each individual publication, patent or patent application was specifically and individually indicated to be incorporated by reference.

Although the foregoing disclosure has been described in some detail by way of illustration and example for purposes of clarity of understanding, certain changes and modifications may be practiced within the scope of the embodiments.

SEQUENCE LISTING (160 sequences)

SEQ ID NO: 1 - protein, 657 aa, Bacillus thuringiensis
MTSNRKNENEIINALSIPAVSNHSAQMDLSLDARIEDSLCIAEGNNINPLVSASTVQTGINIAGRILGVLGVPFAGQLASFYSFLVGELWPSGRDPWEIFLEHVEQLIRQQVTENTRNTAIARLEGLGRGYRSYQQALETWLDNRNDARSRSIILERYVALELDITTAIPLFRIRNEEVPLLMVYAQAANLHLLLLRDASLFGSEWGMASSDVNQYYQEQIRYTEEYSNHCVQWYNTGLNNLRGTNAESWLRYNQFRRDLTLGVLDLVALFPSYDTRTYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTQGLTNNTSINPVTLQFTSRDVYRTESNAGTNILFTTPVNGVPWARFNFINPQNIYERGATTYSQPYQGVGIQLFDSETELPPETTERPNYESYSHRLSHIGLIIGNTLRAPVYSWTHRSADRTNTIGPNRITQIPAVKGRFLFNGSVISGPGFTGGDVVRLNRNNGNIQNRGYIEVPIQFTSTSTRYRVRVRYASVTSIELNVNLGNSSIFTNTLPATAASLDNLQSGDFGYVEINNAFTSATGNIVGARNFSANAEVIIDRFEFIPVTATFEAEYDLERAQK

SEQ ID NO: 2 - DNA, 1971 bp, Bacillus thuringiensis
atgccttcaaataggaaaaatgagaatgaaattataaatgccttatcgattccagctgtatcgaatcattccgcacaaatggatctatcgctagatgctcgtattgaggattctttgtgtatagccgaggggaataatatcaatccacttgttagcgcatcaacagtccaaacgggtataaacatagctggtagaatattgggcgtattaggtgtgccgtttgctggacaactagctagtttttatagttttcttgttggggaattatggcctagtggcagagatccatgggaaattttcctggaacatgtagaacaacttataagacaacaagtaacagaaaatactaggaatacggctattgctcgattagaaggtctaggaagaggctatagatcttaccagcaggctcttgaaacttggttagataaccgaaatgatgcaagatcaagaagcattattcttgagcgctatgttgctttagaacttgacattactactgctataccgcttttcagaatacgaaatgaagaagttccattattaatggtatatgctcaagctgcaaatttacacctattattattgagagacgcatccctttttggtagtgaatgggggatggcatcttccgatgttaaccaatattaccaagaacaaatcagatatacagaggaatattctaaccattgcgtacaatggtataatacagggctaaataacttaagagggacaaatgctgaaagttggttgcggtataatcaattccgtagagacctaacgttaggggtattagatttagtagccctattcccaagctatgatactcgcacttatccaatcaatacgagtgctcagttaacaagagaaatttatacagatccaattgggagaacaaatgcaccttcaggatttgcaagtacgaattggtttaataataatgcaccatcgttttctgccatagaggctgccattttcaggcctccgcatctacttgattttccagaacaacttacaatttacagtgcatcaagccgttggagtagcactcaacatatgaattattgggtgggacataggcttaacttccgcccaataggagggacattaaatacctcaacacaaggacttactaataatacttcaattaatcctgtaacattacagtttacgtctcgtgacgtttatagaacagaatcaaatgcagggacaaatatactatttactactcctgtgaatggagtaccttgggctagatttaattttataaaccctcagaatatttatgaaagaggcgccactacctacagtcaaccgtatcagggagttgggattcaattatttgattcagaaactgaattaccaccagaaacaacagaacgaccaaattatgaatcatatagtcatagattatctcatataggactaatcataggaaacactttgagagcaccagtctattcttggacgcatcgtagtgcagatcgtacgaatacgattggaccaaatagaattactcaaattcctgcagtgaagggaagatttctttttaatggttctgtaatttcaggaccaggatttactggtggagacgtagttagattgaataggaataatggtaatattcaaaatagagggtatattgaagttccaattcaattcacgtcgacatctaccagatatcgagttcgagtacgttatgcttctgtaacctcgattgagctcaatgttaatttgggcaattcatcaatttttacgaacacattaccagcaacagctgcatcattagataatctacaatcaggggattttggttatgttgaaatcaacaatgcttttacatccgcaacaggtaatatagtaggtgctagaaattttagtgcaaatgcagaagtaataatagacagatttgaatttatcccagttactgcaaccttcgaggcagaatatgatttagaaagagcacaaaag

SEQ ID NO: 3 - protein, 651 aa, Artificial Sequence
  Cry1B variant
MPSNRKNENEIINAVSNHSAQMDLSLDARIEDSLCVAEVNNIDPFVSASTVQTGISIAGRILGVLGVPFAGQLASFYSFLVGELWPSGRDPWEIFMEHVEQIVRQQITDSVRDTAIARLEGLGRGYRSYQQALETWLDNRNDARSRSIIRERYIALELDITTAIPLFSIRNQEVPLLMVYAQAANLHLLLLRDASLFGSEWGMSSSDVNQYYQEQIRYTEEYSNHCVQWYNTGLNNLRGTNAESWLRYNQFRRDLTLGVLDLVALFPSYDTRVYPMNTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESFAGTNILFTTPVNGVPWARFNFINPQNIYERGATTYSQPYQGVGIQLFDSETELPPETTERPNYESYSHRLSHIGLIIGNTLRAPVYSWTHRSADRTNTIGPNRITQIPAVKGRFLFNGSVISGPGFTGGDVVRLNRNNGNIQNRGYIEVPIQFTSTSTRYRVRVRYASVTSIELNVNLGNSSIFTNTLPATAASLDNLQSGDFGYVEINNAFTSATGNIVGARNFSANAEVIIDRFEFIPVTATFEAEYDLERAQK

SEQ ID NO: 4 - DNA, 1953 bp, Artificial Sequence
  coding sequence of Cry1B variant
atgccttcaaataggaaaaatgagaatgaaattataaatgctgtatcgaatcattccgcacaaatggatctatcgctagatgctcgtattgaagatagcttgtgtgtagccgaggtgaacaatattgatccatttgttagcgcatcaacagtccaaacaggtattagtatagctggtagaatattgggcgtattaggtgtgccgtttgctggacaactagctagtttttatagttttcttgttggggaattatggcctagcggcagagatccatgggaaatttttatggaacatgtcgagcaaattgtaagacaacaaataacggacagtgttagggataccgctattgctcgtttagaaggtctaggaagagggtatagatcttaccagcaggctcttgaaacttggttagataaccgaaatgatgcaagatcaagaagcattattcgtgagagatatattgctttagaacttgacattactactgctataccgcttttcagcatacgaaatcaagaggttccattattaatggtatatgctcaagctgcaaatttacacctattattattgagagacgcatccctttttggtagtgaatgggggatgtcatcttccgatgttaaccaatattaccaagaacaaatcagatatacagaggaatattctaaccattgcgtacaatggtataatacagggctaaataacttaagagggacaaatgctgaaagttggttgcggtataatcaattccgtagagatctaacgttaggagtattagatctagtggcactattcccaagctatgacacgcgtgtttatccaatgaataccagtgctcaattaacaagagaaatttatacagatccaattgggagaacaaatgcaccttcaggatttgcaagtacgaattggtttaataataatgcaccatcgttttctgccatagaggctgccattttcaggcctccgcatctacttgattttccagaacaacttacaatttacagtgcatcaagccgttggagtagcactcaacatatgaattattgggtgggacataggcttaacttccgcccaataggagggacattaaatacctcaacgcatggggctaccaatacttctattaatcctgtaacattacagttcacatctcgagacgtttataggactgaatcatttgcagggacaaatatactatttactactcctgtgaatggagtaccttgggctagatttaattttataaaccctcagaatatttatgaaagaggcgccactacctacagtcaaccgtatcagggagttgggattcaattatttgattcagaaactgaattaccaccagaaacaacagaacgaccaaattatgaatcatatagtcatagattatctcatataggactaatcataggaaacactttgagagcaccagtctattcttggacgcaccgtagtgcagatcgtacgaatacgattggaccaaatagaattactcaaattcctgcagtgaagggaagatttctttttaatggttctgtaatttcaggaccaggatttactggtggagacgtagttagattgaataggaataatggtaatattcaaaatagagggtatattgaagttccaattcaattcacgtcgacatctaccagatatcgagttcgagtacgttatgcttctgtaacctcgattgagctcaatgttaatttgggcaattcatcaatttttacgaacacattaccagcaacagctgcatcattagataatctacaatcaggggattttggttatgttgaaatcaacaatgcttttacatccgcaacaggtaatatagtaggtgctagaaattttagtgcaaatgcagaagtaataatagacagatttgaatttatcccagttactgcaaccttcgaggcagaatatgatttagaaagagcacaaaag

SEQ ID NO: 5 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQQITENARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGNTLRAPVYSWTHRSADRTNTIATNIITQIPAVKGNFLFNGSVISGPGFTGGDLVRLNNSGNNIQNRGYIEVPIQFISTSTRYRVRVRYASVTPIQLSVNWGNSNIFSSIVPATATSLDNLQSRNFGYFESTNAFTSATGNVVGVRNFSENAGVIIDRFEFIPVTATFEAEYDLERAQE

SEQ ID NO: 6 - DNA, 1965 bp, Artificial Sequence
  coding sequence of Cry1B variant
atgccgagcaatcgtaagaatgaaaatgaaatcattaacgcactgtccatccctgcagtgagcaatcacagcgcgcagatggatttgagcctggatgcgcgtatcgaggacagcctgtgtattgccgagggcaacaacatcaatccgttggtcagcgcgagcaccgtgcaaaccggcattaacattgccggtcgtatcctgggtgtcctgggcgttccgtttgcgggtcagctggcgagcttttacagctttatcgttggtgagttgtggccgtcgggtcgtgacccttgggagattttcatggagcacgtcgagcaactggtgcgccaacagattacggagaatgcgcgcaacaccgctctggcgcgtctgcaaggtctgggtgcaagcttccgcgcttaccagcagtccctggaagattggttggaaaaccgtgataatgcgcgcactcgctccgtcctgtacacgcagtacatcgcgctggagctggacttcttgaacgcgatgccgctgtttgcaatcaacaaccagcaagtgccgctgctgatggtctacgcccaagccgcgaatctgcacttgctgctgctgcgcgacgcatctctgttcggtagcgaatttggcctgaccagccaggagatccagcgctactatgagcgtcaggccgagaaaacgcgtgaatactccgactactgcgctcgttggtacaacacgggtctgaacaatctgcgtggcaccaacgcggagtcctggctgcgttacaaccagtttcgtcgcgatctgaccctgggtgttttggatttggttgcgctgtttccgagctatgacacccgcatctatccgatcaacaccagcgcgcaactgactcgtgaaatctatacggacccgattggccgcactaatgcaccgtccggtttcgcaagcaccaactggttcaataacaatgcaccgagcttcagcgcgatcgaggccgcgatctttcgtccgccgcacctgttggacttcccggagcagctgaccatctactctgcatctagccgttggagcagcacgcagcacatgaattactgggttggccatcgtctgaacttccgcccgattggtggtacgctgaacactagcacgcacggtgccactaacacgagcatcaacccggtgacgctgcaattcaccagccgtgatgtttaccgtaccgagtcctacgccggcatcaacattctgctgaccaccccggttaacggcgtcccttgggctcgtttcaattggcgtaacccactgaatagcctgcgtggttctttgctgtacaccattggttataccggcgtcggtacgcaactgtttgactcggaaactgagctgccaccggaaactaccgagcgtccgaactacgaatcttatagccaccgtctgtccaatatccgtctgatcatcggcaacaccctgcgtgcgccggtgtacagctggacccatcgtagcgccgatcgcacgaacacgattgccaccaacattatcacccagatcccggcagtgaaaggcaactttctgtttaacggcagcgtgatcagcggtccaggttttaccggcggtgacctggtgcgcctgaacaacagcggcaacaatatccaaaaccgtggttatatcgaagtcccgattcaattcatcagcacgagcacccgttaccgcgtccgtgttcgctacgcatccgttacgccgatccaactgagcgttaactggggcaattccaacattttcagcagcattgtccctgctacggcgacctctctggacaatttgcagagccgtaacttcggctatttcgaaagcaccaacgctttcaccagcgctacgggcaatgtggttggtgttcgcaatttcagcgagaatgcgggcgtcatcattgaccgttttgagtttatcccggtgaccgcgaccttcgaagcggagtacgatctggagcgtgcgcaggaa

SEQ ID NO: 7 - protein, 655 aa, Artificial Sequence
  Cry1B variant
MPSNRKNENGIINALSIPAVSNHSAQMDLSPDARIEDSLCVAEVNNIDPFVSASTVQTGINIAGRILGVLGVPFAGQLASFYSFIVGELWPSGRDPWEIFLEHVEQLVRQQITENARNTALARLQGLGASFRAYQQSLEDWLENRDDARTRSVLYTQYIALELDFLNAMPLFAINNQRVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRVYPINTSAQLTREIYTDPIGRTNAPSGFASTNWFNNNAPSFSAIEAAVIRPPHLLDFPEQLTIFSVLSRWSSTQHMNYWVGHRLESRTIRGSLSTSTHGNTNTSINPVTLQFTSRDVYRTESYAGINILLTTPVNGVPWARFNWRNPLNSLRGSLLYTIGYTGVGTQLFDSETELPPETTERPNYESYSHRLSHIGLIIGNTLRAPVYSWTHRSADRTNTTGPNRITQIPAVKGNFLFNGSVISGPGFTGGDLVRLNNSGNNIQNRGYLEVPIQFISTSTRYRVRVRYASVTPIQLSVNWGNSNIFSSIVPATATSLDNLQSRDFGYFESTNAFTSATGNVVGVRNFSENAGVIIDRFEFIPVTATFEAEYDLERAQE

SEQ ID NO: 8 - DNA, 1965 bp, Artificial Sequence
  coding sequence of Cry1B variant
atgccgagcaatcgtaagaatgaaaatggaatcattaacgcgctgtccatccctgcagtgagcaatcacagcgcgcagatggatttgagcccggatgcgcgtatcgaggacagcctgtgtgtcgccgaggtaaacaatattgatccgttcgtcagcgcgagcaccgtgcaaaccggcattaacattgccggtcgtatcctgggtgtcctgggcgttccgtttgcgggtcagctggcgagcttttacagctttatcgttggtgagttgtggccgtcgggtcgtgacccttgggagattttcttggagcacgtcgagcaactggtgcgccaacagattacggagaatgcgcgcaacaccgctctggcgcgtctgcaaggtctgggtgcaagcttccgcgcttaccagcagtccctggaagattggttggaaaaccgtgatgatgcgcgcactcgctccgtcctgtacacgcagtacatcgcgctggagctggacttcttgaacgcgatgccgctgtttgcaatcaacaaccagcgagtgccgctgctgatggtctacgcccaagccgcgaatctgcacttgctgctgctgcgcgacgcatctctgttcggtagcgaatttggcctgaccagccaggagatccagcgctactatgagcgtcaggccgagaaaacgcgtgaatactccgactactgcgctcgttggtacaacacgggtctgaacaatctgcgtggcaccaacgcggagtcctggctgcgttataaccagtttcgtcgcgatctgaccctgggtgtattggatttggttgcgctgtttccgagctatgacacccgcgtgtatccgatcaacaccagcgcgcaactgactcgtgaaatctatacggacccgattggccgcactaatgcaccgtccggtttcgcaagcaccaactggttcaataacaatgcaccgagcttcagcgcgatcgaggcggctgtcatccgtccgccgcacctgttggacttcccggagcagctgaccatcttttctgtgttgtctcgttggagcagcacgcagcacatgaattactgggttggccatcgtctggaaagccgcaccattcgcggtagcctgagcactagcacgcacggtaatactaacacgagcatcaacccggtgacgctgcaattcaccagccgtgatgtttaccgtaccgagtcctacgccggcatcaacattctgctgaccaccccggttaacggcgtcccttgggctcgtttcaattggcgtaacccactgaatagcctgcgtggttctttgctgtacaccattggttataccggcgtcggtacgcaactgtttgactcggaaactgagctgccaccggaaactaccgagcgtccgaactacgaatcttatagccaccgtctgtcccatattggtctgatcatcggcaacaccctgcgtgcaccggtgtacagctggacccatcgtagcgccgatcgcacgaacacgactggtccgaaccgtatcacccagatcccggcagtgaaaggcaactttctgtttaacggcagcgtgatcagcggtccaggttttaccggcggtgacctggtgcgcctgaacaacagcggcaacaatatccaaaaccgtggttatctggaagtcccgattcaattcatcagcacgagcacccgttaccgcgtccgtgttcgctacgcatccgttacgccgatccaactgagcgttaactggggcaattccaacattttcagcagcattgtccctgctacggcgacctctctggacaatttgcagagccgtgacttcggctatttcgaaagcaccaacgctttcaccagcgctacgggcaatgtggttggtgttcgcaatttcagcgagaatgcgggcgtcatcattgaccgttttgagtttatcccggtgaccgcgaccttcgaagcggagtacgatctggagcgtgcgcaggaa

SEQ ID NO: 9 - protein, 650 aa, Artificial Sequence
  Cry1B variant
MPSNRKNENEIINAVSNHSAQMDLSPDARIEDSLCVAEVNNIDPFVSASTVQTGINIAGRILGVLGVPFAGQLASFYSFLVGELWPSGRDPWEIFMEHVEQIVRQQITENARNTALARLQGLGASFRAYQQSLEDWLENRDDARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAVIRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGIQLFDSETELPPETTERPNYESYSHRLSNIRLISGNTLRAPVYSWTHRSADRTNTIATNIITQIPAVKGNFLFNGSVTSGPGFTGGDLVRLNNSGNNIQNRGYLEVPIQFISTSTRYRVRVRYASVTPIQLSVNWGNSNIFSSIVPATATSLDNLQSRDFGYFESTNAFTSATGNVVGVRNFSENAGVIIDRFEFIPVTATFEAEYDLERAQE

SEQ ID NO: 10 - DNA, 1950 bp, Artificial Sequence
  coding sequence of Cry1B variant
atgccgagcaatcgtaagaatgaaaatgaaatcattaacgcagtgagcaatcacagcgcgcagatggatttgagcccggatgcgcgtatcgaggacagcctgtgtgtcgccgaggtaaacaatattgatccgttcgtcagcgcgagcaccgtgcaaaccggcattaacattgccggtcgtatcctgggtgtcctgggcgttccgtttgcgggtcagctggcgagcttttacagctttttggttggtgagttgtggccgtcgggtcgtgacccttgggagattttcatggagcacgtcgagcaaattgtgcgccaacagattacggagaatgcgcgcaacaccgctctggcgcgtctgcaaggtctgggtgcaagcttccgcgcttaccagcagtccctggaagattggttggaaaaccgtgatgatgcgcgcactcgctccgtcctgtacacgcagtacatcgcgctggagctggacttcttgaacgcgatgccgctgtttgcaatcaacaaccagcaagtgccgctgctgatggtctacgcccaagccgcgaatctgcacttgctgctgctgcgcgacgcatctctgttcggtagcgaatttggcctgaccagccaggagatccagcgctactatgagcgtcaggccgagaaaacgcgtgaatactccgactactgcgctcgttggtacaacacgggtctgaacaatctgcgtggcaccaacgcggagtcctggctgcgttacaaccagtttcgtcgcgatctgaccctgggtgttttggatttggttgcgctgtttccgagctatgacacccgcatctatccgatcaacaccagcgcgcaactgactcgtgaaatctatacggacccgattggccgcactaatgcaccgtccggtttcgcaagcaccaactggttcaataacaatgcaccgagcttcagcgcgatcgaggcggctgtcatccgtccgccgcacctgttggacttcccggagcagctgaccatctactctgcatctagccgttggagcagcacgcagcacatgaattactgggttggccatcgtctgaacttccgcccgattggtggtacgctgaacactagcacgcacggtgccactaacacgagcatcaacccggtgacgctgcaattcaccagccgtgatgtttaccgtaccgagtcctacgccgggatcaacattctgctgaccaccccggttaacggcgtcccttgggctcgtttcaattggcgtaacccactgaatagcctgcgtggttctttgctgtacaccattggttataccggcgtcggtattcaactgtttgactcggaaactgagctgccaccggaaactaccgagcgtccgaactacgaatcttatagccaccgtctgtccaatatccgtctgatcagcggcaacaccctgcgtgcgccggtgtacagctggacccaccgtagcgccgatcgcacgaacacgattgccaccaacattatcacccagatcccggcagtgaaaggcaactttctgtttaacggcagcgtgaccagcggtccaggttttaccggcggtgacctggtgcgcctgaacaacagcggcaacaatatccaaaaccgtggttatctggaagtcccgattcaattcatcagcacgagcacccgttaccgcgtccgtgttcgctacgcatccgttacgccgatccaactgagcgttaactggggcaattccaacattttcagcagcattgtccctgctacggcgacctctctggacaatttgcagagccgtgacttcggctatttcgaaagcaccaacgctttcaccagcgctacgggcaatgtggttggtgttcgcaatttcagcgagaatgcgggcgtcatcattgaccgttttgagtttatcccggtgaccgcgaccttcgaagcggagtacgatctggagcgtgcgcaggaa

SEQ ID NO: 11 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQQITENARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGNTLRAPVYSWTHRSADRTNTIATNIITQIPAVKGNFLFNGSVISGPGFTGGDLVRLNNSGNNIQNRGYIEVPIQFISTSTRYRVRVRYASVTPIQLSVNWGNSNIFSRIVPATAYSLDNLQSRNFGYFESTNAFTSATGNVVGVRNFSENAGVIIDRFEFIPVTATFEAEYDLERAQE

SEQ ID NO: 12 - DNA, 1965 bp, Artificial Sequence
  coding sequence of Cry1B variant
atgccgagcaatcgtaagaatgaaaatgaaatcattaacgcactgtccatccctgcagtgagcaatcacagcgcgcagatggatttgagcctggatgcgcgtatcgaggacagcctgtgtattgccgagggcaacaacatcaatccgttggtcagcgcgagcaccgtgcaaaccggcattaacattgccggtcgtatcctgggtgtcctgggcgttccgtttgcgggtcagctggcgagcttttacagctttatcgttggtgagttgtggccgtcgggtcgtgacccttgggagattttcatggagcacgtcgagcaactggtgcgccaacagattacggagaatgcgcgcaacaccgctctggcgcgtctgcaaggtctgggtgcaagcttccgcgcttaccagcagtccctggaagattggttggaaaaccgtgataatgcgcgcactcgctccgtcctgtacacgcagtacatcgcgctggagctggacttcttgaacgcgatgccgctgtttgcaatcaacaaccagcaagtgccgctgctgatggtctacgcccaagccgcgaatctgcacttgctgctgctgcgcgacgcatctctgttcggtagcgaatttggcctgaccagccaggagatccagcgctactatgagcgtcaggccgagaaaacgcgtgaatactccgactactgcgctcgttggtacaacacgggtctgaacaatctgcgtggcaccaacgcggagtcctggctgcgttacaaccagtttcgtcgcgatctgaccctgggtgttttggatttggttgcgctgtttccgagctatgacacccgcatctatccgatcaacaccagcgcgcaactgactcgtgaaatctatacggacccgattggccgcactaatgcaccgtccggtttcgcaagcaccaactggttcaataacaatgcaccgagcttcagcgcgatcgaggccgcgatctttcgtccgccgcacctgttggacttcccggagcagctgaccatctactctgcatctagccgttggagcagcacgcagcacatgaattactgggttggccatcgtctgaacttccgcccgattggtggtacgctgaacactagcacgcacggtgccactaacacgagcatcaacccggtgacgctgcaattcaccagccgtgatgtttaccgtaccgagtcctacgccggcatcaacattctgctgaccaccccggttaacggcgtcccttgggctcgtttcaattggcgtaacccactgaatagcctgcgtggttctttgctgtacaccattggttataccggcgtcggtacgcaactgtttgactcggaaactgagctgccaccggaaactaccgagcgtccgaactacgaatcttatagccaccgtctgtccaatatccgtctgatcatcggcaacaccctgcgtgcgccggtgtacagctggacccatcgtagcgccgatcgcacgaacacgattgccaccaacattatcacccagatcccggcagtgaaaggcaactttctgtttaacggcagcgtgatcagcggtccaggttttaccggcggtgacctggtgcgcctgaacaacagcggcaacaatatccaaaaccgtggttatatcgaagtcccgattcaattcatcagcacgagcacccgttaccgcgtccgtgttcgctacgcatccgttacgccgatccaactgagcgttaactggggcaattccaacattttcagccgcattgtccctgctacggcgtactctctggacaatttgcagagccgtaacttcggctatttcgaaagcaccaacgctttcaccagcgctacgggcaatgtggttggtgttcgcaatttcagcgagaatgcgggcgtcatcattgaccgttttgagtttatcccggtgaccgcgaccttcgaagcggagtacgatctggagcgtgcgcaggaa

SEQ ID NO: 13 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQQITENARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGNTLRAPVYSWTHRSADRTNTIATNIITQIPAVKGNFLFNGSVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 14 - DNA, 1965 bp, Artificial Sequence
  coding sequence of Cry1B variant
atgccgagcaatcgtaagaatgaaaatgaaatcattaacgcactgtccatccctgcagtgagcaatcacagcgcgcagatggatttgagcctggatgcgcgtatcgaggacagcctgtgtattgccgagggcaacaacatcaatccgttggtcagcgcgagcaccgtgcaaaccggcattaacattgccggtcgtatcctgggtgtcctgggcgttccgtttgcgggtcagctggcgagcttttacagctttatcgttggtgagttgtggccgtcgggtcgtgacccttgggagattttcatggagcacgtcgagcaactggtgcgccaacagattacggagaatgcgcgcaacaccgctctggcgcgtctgcaaggtctgggtgcaagcttccgcgcttaccagcagtccctggaagattggttggaaaaccgtgataatgcgcgcactcgctccgtcctgtacacgcagtacatcgcgctggagctggacttcttgaacgcgatgccgctgtttgcaatcaacaaccagcaagtgccgctgctgatggtctacgcccaagccgcgaatctgcacttgctgctgctgcgcgacgcatctctgttcggtagcgaatttggcctgaccagccaggagatccagcgctactatgagcgtcaggccgagaaaacgcgtgaatactccgactactgcgctcgttggtacaacacgggtctgaacaatctgcgtggcaccaacgcggagtcctggctgcgttacaaccagtttcgtcgcgatctgaccctgggtgttttggatttggttgcgctgtttccgagctatgacacccgcatctatccgatcaacaccagcgcgcaactgactcgtgaaatctatacggacccgattggccgcactaatgcaccgtccggtttcgcaagcaccaactggttcaataacaatgcaccgagcttcagcgcgatcgaggccgcgatctttcgtccgccgcacctgttggacttcccggagcagctgaccatctactctgcatctagccgttggagcagcacgcagcacatgaattactgggttggccatcgtctgaacttccgcccgattggtggtacgctgaacactagcacgcacggtgccactaacacgagcatcaacccggtgacgctgcaattcaccagccgtgatgtttaccgtaccgagtcctacgccggcatcaacattctgctgaccaccccggttaacggcgtcccttgggctcgtttcaattggcgtaacccactgaatagcctgcgtggttctttgctgtacaccattggttataccggcgtcggtacgcaactgtttgactcggaaactgagctgccaccggaaactaccgagcgtccgaactacgaatcttatagccaccgtctgtccaatatccgtctgatcatcggcaacaccctgcgtgcgccggtgtacagctggacccatcgtagcgccgatcgcacgaacacgattgccaccaacattatcacccagatcccggcagtgaaaggcaactttctgtttaacggcagcgtgatcagcggtccaggttttaccggcggtgacctggtgcgcctgaacaacagcggcaacaatatccaaaaccgtggttatatcgaagtcccgattcaattcatcagcacgagcacccgttaccgcgtccgtgttcgctacgcatccgttacgccgatccgcctgagcgttaactggggcaattccaacattttcagcagcattgtccctgctacggcgacctctctggacaatttgcagagccgtaacttcggctatttcgaaagccgcaacgctttcaccagcgctacgggcaatgtggttggtgttcgcaatttcagcgagaatgcgggcgtcatcattgaccgttttgagtttatcccggtgaccgcgaccttcgaagcggagtacgatctggagcgtgcgcaggaa

SEQ ID NO: 15 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQQITENARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIISNTLRAPVYSWTHRSADRTNTIATNIITQIPAVKGNFLFNGSVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 16 - DNA, 1965 bp, Artificial Sequence
  coding sequence of Cry1B variant
atgccgagcaatcgtaagaatgaaaatgaaatcattaacgcactgtccatccctgcagtgagcaatcacagcgcgcagatggatttgagcctggatgcgcgtatcgaggacagcctgtgtattgccgagggcaacaacatcaatccgttggtcagcgcgagcaccgtgcaaaccggcattaacattgccggtcgtatcctgggtgtcctgggcgttccgtttgcgggtcagctggcgagcttttacagctttatcgttggtgagttgtggccgtcgggtcgtgacccttgggagattttcatggagcacgtcgagcaactggtgcgccaacagattacggagaatgcgcgcaacaccgctctggcgcgtctgcaaggtctgggtgcaagcttccgcgcttaccagcagtccctggaagattggttggaaaaccgtgataatgcgcgcactcgctccgtcctgtacacgcagtacatcgcgctggagctggacttcttgaacgcgatgccgctgtttgcaatcaacaaccagcaagtgccgctgctgatggtctacgcccaagccgcgaatctgcacttgctgctgctgcgcgacgcatctctgttcggtagcgaatttggcctgaccagccaggagatccagcgctactatgagcgtcaggccgagaaaacgcgtgaatactccgactactgcgctcgttggtacaacacgggtctgaacaatctgcgtggcaccaacgcggagtcctggctgcgttacaaccagtttcgtcgcgatctgaccctgggtgttttggatttggttgcgctgtttccgagctatgacacccgcatctatccgatcaacaccagcgcgcaactgactcgtgaaatctatacggacccgattggccgcactaatgcaccgtccggtttcgcaagcaccaactggttcaataacaatgcaccgagcttcagcgcgatcgaggccgcgatctttcgtccgccgcacctgttggacttcccggagcagctgaccatctactctgcatctagccgttggagcagcacgcagcacatgaattactgggttggccatcgtctgaacttccgcccgattggtggtacgctgaacactagcacgcacggtgccactaacacgagcatcaacccggtgacgctgcaattcaccagccgtgatgtttaccgtaccgagtcctacgccggcatcaacattctgctgaccaccccggttaacggcgtcccttgggctcgtttcaattggcgtaacccactgaatagcctgcgtggttctttgctgtacaccattggttataccggcgtcggtacgcaactgtttgactcggaaactgagctgccaccggaaactaccgagcgtccgaactacgaatcttatagccaccgtctgtccaatatccgtctgatcatcagcaacaccctgcgtgcgccggtgtacagctggacccatcgtagcgccgatcgcacgaacacgattgccaccaacattatcacccagatcccggcagtgaaaggcaactttctgtttaacggcagcgtgatcagcggtccaggttttaccggcggtgacctggtgcgcctgaacaacagcggcaacaatatccaaaaccgtggttatatcgaagtcccgattcaattcatcagcacgagcacccgttaccgcgtccgtgttcgctacgcatccgttacgccgatccgcctgagcgttaactggggcaattccaacattttcagcagcattgtccctgctacggcgacctctctggacaatttgcagagccgtaacttcggctatttcgaaagccgcaacgctttcaccagcgctacgggcaatgtggttggtgttcgcaatttcagcgagaatgcgggcgtcatcattgaccgttttgagtttatcccggtgaccgcgaccttcgaagcggagtacgatctggagcgtgcgcaggaa

SEQ ID NO: 17 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQAITLNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIISGTLRAPVYSWTHRSADRTNTIATNIITQIPAVKGNFLFNGSVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 18 - DNA, 1965 bp, Artificial Sequence
  coding sequence of Cry1B variant
atgccgagcaatcgtaagaatgaaaatgaaatcattaacgcactgtccatccctgcagtgagcaatcacagcgcgcagatggatttgagcctggatgcgcgtatcgaggacagcctgtgtattgccgagggcaacaacatcaatccgttggtcagcgcgagcaccgtgcaaaccggcattaacattgccggtcgtatcctgggtgtcctgggcgttccgtttgcgggtcagctggcgagcttttacagctttatcgttggtgagttgtggccgtcgggtcgtgacccttgggagattttcatggagcacgtcgagcaactggtgcgccaagcgattacgctgaatgcgcgcaacaccgctctggcgcgtctgcaaggtctgggtgcaagcttccgcgcttaccagcagtccctggaagattggttggaaaaccgtgataatgcgcgcactcgctccgtcctgtacacgcagtacatcgcgctggagctggacttcttgaacgcgatgccgctgtttgcaatcaacaaccagcaagtgccgctgctgatggtctacgcccaagccgcgaatctgcacttgctgctgctgcgcgacgcatctctgttcggtagcgaatttggcctgaccagccaggagatccagcgctactatgagcgtcaggccgagaaaacgcgtgaatactccgactactgcgctcgttggtacaacacgggtctgaacaatctgcgtggcaccaacgcggagtcctggctgcgttacaaccagtttcgtcgcgatctgaccctgggtgttttggatttggttgcgctgtttccgagctatgacacccgcatctatccgatcaacaccagcgcgcaactgactcgtgaaatctatacggacccgattggccgcactaatgcaccgtccggtttcgcaagcaccaactggttcaataacaatgcaccgagcttcagcgcgatcgaggccgcgatctttcgtccgccgcacctgttggacttcccggagcagctgaccatctactctgcatctagccgttggagcagcacgcagcacatgaattactgggttggccatcgtctgaacttccgcccgattggtggtacgctgaacactagcacgcacggtgccactaacacgagcatcaacccggtgacgctgcaattcaccagccgtgatgtttaccgtaccgagtcctacgccggcatcaacattctgctgaccaccccggttaacggcgtcccttgggctcgtttcaattggcgtaacccactgaatagcctgcgtggttctttgctgtacaccattggttataccggcgtcggtacgcaactgtttgactcggaaactgagctgccaccggaaactaccgagcgtccgaactacgaatcttatagccaccgtctgtccaatatccgtctgatcatcagcggcaccctgcgtgcgccggtgtacagctggacccatcgtagcgccgatcgcacgaacacgattgccaccaacattatcacccagatcccggcagtgaaaggcaactttctgtttaacggcagcgtgatcagcggtccaggttttaccggcggtgacctggtgcgcctgaacaacagcggcaacaatatccaaaaccgtggttatatcgaagtcccgattcaattcatcagcacgagcacccgttaccgcgtccgtgttcgctacgcatccgttacgccgatccgcctgagcgttaactggggcaattccaacattttcagcagcattgtccctgctacggcgacctctctggacaatttgcagagccgtaacttcggctatttcgaaagccgcaacgctttcaccagcgctacgggcaatgtggttggtgttcgcaatttcagcgagaatgcgggcgtcatcattgaccgttttgagtttatcccggtgaccgcgaccttcgaagcggagtacgatctggagcgtgcgcaggaa

SEQ ID NO: 19 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQAITLNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLYFRPINGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGNTLRAPVYSWTHRSADRTNTIATNIITQIPAVKGNFLFNGSVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 20 - DNA, 1965 bp, Artificial Sequence
  coding sequence of Cry1B variant
atgccgagcaatcgtaagaatgaaaatgaaatcattaacgcactgtccatccctgcagtgagcaatcacagcgcgcagatggatttgagcctggatgcgcgtatcgaggacagcctgtgtattgccgagggcaacaacatcaatccgttggtcagcgcgagcaccgtgcaaaccggcattaacattgccggtcgtatcctgggtgtcctgggcgttccgtttgcgggtcagctggcgagcttttacagctttatcgttggtgagttgtggccgtcgggtcgtgacccttgggagattttcatggagcacgtcgagcaactggtgcgccaagcgattacgctgaatgcgcgcaacaccgctctggcgcgtctgcaaggtctgggtgcaagcttccgcgcttaccagcagtccctggaagattggttggaaaaccgtgataatgcgcgcactcgctccgtcctgtacacgcagtacatcgcgctggagctggacttcttgaacgcgatgccgctgtttgcaatcaacaaccagcaagtgccgctgctgatggtctacgcccaagccgcgaatctgcacttgctgctgctgcgcgacgcatctctgttcggtagcgaatttggcctgaccagccaggagatccagcgctactatgagcgtcaggccgagaaaacgcgtgaatactccgactactgcgctcgttggtacaacacgggtctgaacaatctgcgtggcaccaacgcggagtcctggctgcgttacaaccagtttcgtcgcgatctgaccctgggtgttttggatttggttgcgctgtttccgagctatgacacccgcatctatccgatcaacaccagcgcgcaactgactcgtgaaatctatacggacccgattggccgcactaatgcaccgtccggtttcgcaagcaccaactggttcaataacaatgcaccgagcttcagcgcgatcgaggccgcgatctttcgtccgccgcacctgttggacttcccggagcagctgaccatctactctgcatctagccgttggagcagcacgcagcacatgaattactgggttggccatcgtctgtatttccgcccgattaacggtacgctgaacactagcacgcacggtgccactaacacgagcatcaacccggtgacgctgcaattcaccagccgtgatgtttaccgtaccgagtcctacgccggcatcaacattctgctgaccaccccggttaacggcgtcccttgggctcgtttcaattggcgtaacccactgaatagcctgcgtggttctttgctgtacaccattggttataccggcgtcggtacgcaactgtttgactcggaaactgagctgccaccggaaactaccgagcgtccgaactacgaatcttatagccaccgtctgtccaatatccgtctgatcatcggcaacaccctgcgtgcgccggtgtacagctggacccatcgtagcgccgatcgcacgaacacgattgccaccaacattatcacccagatcccggcagtgaaaggcaactttctgtttaacggcagcgtgatcagcggtccaggttttaccggcggtgacctggtgcgcctgaacaacagcggcaacaatatccaaaaccgtggttatatcgaagtcccgattcaattcatcagcacgagcacccgttaccgcgtccgtgttcgctacgcatccgttacgccgatccgcctgagcgttaactggggcaattccaacattttcagcagcattgtccctgctacggcgacctctctggacaatttgcagagccgtaacttcggctatttcgaaagccgcaacgctttcaccagcgctacgggcaatgtggttggtgttcgcaatttcagcgagaatgcgggcgtcatcattgaccgttttgagtttatcccggtgaccgcgaccttcgaagcggagtacgatctggagcgtgcgcaggaa

SEQ ID NO: 21 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQAITLNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLYFRPIQGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGNTLRAPVYSWTHRSADRTNTIATNIITQIPAVKGNFLFNGSVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 22 - DNA, 1965 bp, Artificial Sequence
  coding sequence of Cry1B variant
atgccgagcaatcgtaagaatgaaaatgaaatcattaacgcactgtccatccctgcagtgagcaatcacagcgcgcagatggatttgagcctggatgcgcgtatcgaggacagcctgtgtattgccgagggcaacaacatcaatccgttggtcagcgcgagcaccgtgcaaaccggcattaacattgccggtcgtatcctgggtgtcctgggcgttccgtttgcgggtcagctggcgagcttttacagctttatcgttggtgagttgtggccgtcgggtcgtgacccttgggagattttcatggagcacgtcgagcaactggtgcgccaagcgattacgctgaatgcgcgcaacaccgctctggcgcgtctgcaaggtctgggtgcaagcttccgcgcttaccagcagtccctggaagattggttggaaaaccgtgataatgcgcgcactcgctccgtcctgtacacgcagtacatcgcgctggagctggacttcttgaacgcgatgccgctgtttgcaatcaacaaccagcaagtgccgctgctgatggtctacgcccaagccgcgaatctgcacttgctgctgctgcgcgacgcatctctgttcggtagcgaatttggcctgaccagccaggagatccagcgctactatgagcgtcaggccgagaaaacgcgtgaatactccgactactgcgctcgttggtacaacacgggtctgaacaatctgcgtggcaccaacgcggagtcctggctgcgttacaaccagtttcgtcgcgatctgaccctgggtgttttggatttggttgcgctgtttccgagctatgacacccgcatctatccgatcaacaccagcgcgcaactgactcgtgaaatctatacggacccgattggccgcactaatgcaccgtccggtttcgcaagcaccaactggttcaataacaatgcaccgagcttcagcgcgatcgaggccgcgatctttcgtccgccgcacctgttggacttcccggagcagctgaccatctactctgcatctagccgttggagcagcacgcagcacatgaattactgggttggccatcgtctgtatttccgcccgattcagggtacgctgaacactagcacgcacggtgccactaacacgagcatcaacccggtgacgctgcaattcaccagccgtgatgtttaccgtaccgagtcctacgccggcatcaacattctgctgaccaccccggttaacggcgtcccttgggctcgtttcaattggcgtaacccactgaatagcctgcgtggttctttgctgtacaccattggttataccggcgtcggtacgcaactgtttgactcggaaactgagctgccaccggaaactaccgagcgtccgaactacgaatcttatagccaccgtctgtccaatatccgtctgatcatcggcaacaccctgcgtgcgccggtgtacagctggacccatcgtagcgccgatcgcacgaacacgattgccaccaacattatcacccagatcccggcagtgaaaggcaactttctgtttaacggcagcgtgatcagcggtccaggttttaccggcggtgacctggtgcgcctgaacaacagcggcaacaatatccaaaaccgtggttatatcgaagtcccgattcaattcatcagcacgagcacccgttaccgcgtccgtgttcgctacgcatccgttacgccgatccgcctgagcgttaactggggcaattccaacattttcagcagcattgtccctgctacggcgacctctctggacaatttgcagagccgtaacttcggctatttcgaaagccgcaacgctttcaccagcgctacgggcaatgtggttggtgttcgcaatttcagcgagaatgcgggcgtcatcattgaccgttttgagtttatcccggtgaccgcgaccttcgaagcggagtacgatctggagcgtgcgcaggaa

SEQ ID NO: 23 - protein, 663 aa, Artificial Sequence
  Cry1B variant
MPSNRKNENEIINAVSNHSAQMDLSLDARIEDSLCVAEVNNIDPFVSASTVQTGISIAGRILGVLGVPFAGQLASFYSFLVGELWPSGRDPWEIFMEHVEQIVRQQITDSVRDTAIARLEGLGRGYRSYQQALETWLDNRNDARSRSIIRERYIALELDITTAIPLFSIRNQEVPLLMVYAQAANLHLLLLRDASLFGSEWGMSSSDVNQYYQEQIRYTEEYSNHCVQWYNTGLNNLRGTNAESWLRYNQFRRDLTLGVLDLVALFPSYDTRVYPMNTSAQLTREIYTDPIGRTNAPSGFASTNWFNNNAPSFSAIEAAIFRPPHLLDFPEQLTIYSASSRWSSTQHMNYWVGHRLNFRPIGGTLNTSTQGLTNNTSINPVTLQFTSRDVYRTESNAGTNILFTTPVNGVPWARFNFINPQNIYERGATTYSQPYQGVGIQLFDSETELPPETTERPNYESYSHRLSHIGLIIGNTLRAPVYSWTHRSATLTNTIDPERINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQK

SEQ ID NO: 24 - DNA, 1989 bp, Artificial Sequence
  coding sequence of Cry1B variant
atgccttcaaataggaaaaatgagaatgaaattataaatgctgtatcgaatcattccgcacaaatggatctatcgctagatgctcgtattgaagatagcttgtgtgtagccgaggtgaacaatattgatccatttgttagcgcatcaacagtccaaacaggtattagtatagctggtagaatattgggcgtattaggtgtgccgtttgctggacaactagctagtttttatagttttcttgttggggaattatggcctagcggcagagatccatgggaaatttttatggaacatgtcgagcaaattgtaagacaacaaataacggacagtgttagggataccgctattgctcgtttagaaggtctaggaagagggtatagatcttaccagcaggctcttgaaacttggttagataaccgaaatgatgcaagatcaagaagcattattcgtgagagatatattgctttagaacttgacattactactgctataccgcttttcagcatacgaaatcaagaggttccattattaatggtatatgctcaagctgcaaatttacacctattattattgagagacgcatccctttttggtagtgaatgggggatgtcatcttccgatgttaaccaatattaccaagaacaaatcagatatacagaggaatattctaaccattgcgtacaatggtataatacagggctaaataacttaagagggacaaatgctgaaagttggttgcggtataatcaattccgtagagatctaacgttaggagtattagatctagtggcactattcccaagctatgacacgcgtgtttatccaatgaatacgagtgctcagttaacaagagaaatttatacagatccaattgggagaacaaatgcaccttcaggatttgcaagtacgaattggtttaataataatgcaccatcgttttctgccatagaggctgccattttcaggcctccgcatctacttgattttccagaacaacttacaatttacagtgcatcaagccgttggagtagcactcaacatatgaattattgggtgggacataggcttaacttccgcccaataggagggacattaaatacctcaacacaaggacttactaataatacttcaattaatcctgtaacattacagtttacgtctcgtgacgtttatagaacagaatcaaatgcagggacaaatatactatttactactcctgtgaatggagtaccttgggctagatttaattttataaaccctcagaatatttatgaaagaggcgccactacctacagtcaaccgtatcagggagttgggattcaattatttgattcagaaactgaattaccaccagaaacaacagaacgaccaaattatgaatcatatagtcatagattatctcatataggactaatcataggaaacactttgagagcaccagtctattcttggacgcatcgtagtgcaactcttacaaatacaattgatccagagagaattaatcaaatacctttagtgaaaggatttagagtttgggggggcacctctgtcattacaggaccaggatttacaggaggggatatccttcgaagaaatacctttggtgattttgtatctctacaagtcaatattaattcaccaattacccaaagataccgtttaagatttcgttacgcttccagtagggatgcacgagttatagtattaacaggagcggcatccacaggagtgggaggccaagttagtgtaaatatgcctcttcagaaaactatggaaataggggagaacttaacatctagaacatttagatataccgattttagtaatcctttttcatttagagctaatccagatataattgggataagtgaacaacctctatttggtgcaggttctattagtagcggtgaactttatatagataaaattgaaattattctagcagatgcaacatttgaagcagaatctgatttagaaagagcacaaaag

SEQ ID NO: 25 - protein, 663 aa, Artificial Sequence
  Cry1B variant
MPSNRKNENEIINAVSNHSAQMDLSLDARIEDSLCVAEVNNIDPFVSASTVQTGISIAGRILGVLGVPFAGQLASFYSFLVGELWPSGRDPWEIFMEHVEQIVRQQITDSVRDTAIARLEGLGRGYRSYQQALETWLDNRNDARSRSIIRERYIALELDITTAIPLFSIRNQEVPLLMVYAQAANLHLLLLRDASLFGSEWGMSSSDVNQYYQEQIRYTEEYSNHCVQWYNTGLNNLRGTNAESWLRYNQFRRDLTLGVLDLVALFPSYDTRTYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTQGLTNNTSINPVTLQFTSRDVYRTESNAGTNILFTTPVNGVPWARFNFINPQNIYERGATTYSQPYQGVGIQLFDSETELPPETTERPNYESYSHRLSHIGLIIGNTLRAPVYSWTHRSATLTNTIDPERINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLEGARK

SEQ ID NO: 26 - DNA, 1989 bp, Artificial Sequence
  coding sequence of Cry1B variant
atgccttcaaataggaaaaatgagaatgaaattataaatgctgtatcgaatcattccgcacaaatggatctatcgctagatgctcgtattgaagatagcttgtgtgtagccgaggtgaacaatattgatccatttgttagcgcatcaacagtccaaacaggtattagtatagctggtagaatattgggcgtattaggtgtgccgtttgctggacaactagctagtttttatagttttcttgttggggaattatggcctagcggcagagatccatgggaaatttttatggaacatgtcgagcaaattgtaagacaacaaataacggacagtgttagggataccgctattgctcgtttagaaggtctaggaagagggtatagatcttaccagcaggctcttgaaacttggttagataaccgaaatgatgcaagatcaagaagcattattcgtgagagatatattgctttagaacttgacattactactgctataccgcttttcagcatacgaaatcaagaggttccattattaatggtatatgctcaagctgcaaatttacacctattattattgagagacgcatccctttttggtagtgaatgggggatgtcatcttccgatgttaaccaatattaccaagaacaaatcagatatacagaggaatattctaaccattgcgtacaatggtataatacagggctaaataacttaagagggacaaatgctgaaagttggttgcggtataatcaattccgtagagatctaacgttaggagtattagatctagtggcactattcccaagctatgacactcgcacttatccaatcaatacgagtgctcagttaacaagagaaatttatacagatccaattgggagaacaaatgcaccttcaggatttgcaagtacgaattggtttaataataatgcaccatcgttttctgccatagaggctgccattttcaggcctccgcatctacttgattttccagaacaacttacaatttacagtgcatcaagccgttggagtagcactcaacatatgaattattgggtgggacataggcttaacttccgcccaataggagggacattaaatacctcaacacaaggacttactaataatacttcaattaatcctgtaacattacagtttacgtctcgtgacgtttatagaacagaatcaaatgcagggacaaatatactatttactactcctgtgaatggagtaccttgggctagatttaattttataaaccctcagaatatttatgaaagaggcgccactacctacagtcaaccgtatcagggagttgggattcaattatttgattcagaaactgaattaccaccagaaacaacagaacgaccaaattatgaatcatatagtcatagattatctcatataggactaatcataggaaacactttgagagcaccagtctattcttggacgcatcgtagtgcaactcttacaaatacaattgatccagagagaattaatcaaatacctttagtgaaaggatttagagtttgggggggcacctctgtcattacaggaccaggatttacaggaggggatatccttcgaagaaatacctttggtgattttgtatctctacaagtcaatattaattcaccaattacccaaagataccgtttaagatttcgttacgcttccagtagggatgcacgagttatagtattaacaggagcggcatccacaggagtgggaggccaagttagtgtaaatatgcctcttcagaaaactatggaaataggggagaacttaacatctagaacatttagatataccgattttagtaatcctttttcatttagagctaatccagatataattgggataagtgaacaacctctatttggtgcaggttctattagtagcggtgaactttatatagataaaattgaaattattctagcagatgcaacatttgaagcagaatctgatttagaaggggcgcggaag

SEQ ID NO: 27 - protein, 663 aa, Artificial Sequence
  Cry1B variant
MPSNRKNENEIINAVSNHSAQMDLSLDARIEDSLCVAEVNNIDPFVSASTVQTGINIAGRILGVLGVPFAGQLASFYSFLVGELWPSGRDPWEIFMEHVEQIVRQQITDSVRDTAIARLEGLGRGYRSYQQALETWLDNRNDARSRSIILERYIALELDITTAIPLFSIRNQEVPLLMVYAQAANLHLLLLRDASLFGSEWGMASSDVNQYYQEQIRYTEEYSNHCVQWYNTGLNNLRGTNAESWLRYNQFRRDLTLGVLDLVALFPSYDTRTYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTQGLTNNTSINPVTLQFTSRDVYRTESNAGTNILFTTPVNGVPWARFNFINPQNIYERGATTYSQPYQGVGIQLFDSETELPPETTERPNYESYSHRLSHIGLIIGNTLRAPVYSWTHRSATLTNTIDPERINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLEKAQK

SEQ ID NO: 28 - DNA, 1989 bp, Artificial Sequence
  coding sequence of Cry1B variant
atgccttcaaataggaaaaatgagaatgaaattataaatgctgtatcgaatcattccgcacaaatggatctatcgctagatgctcgtattgaagatagcttgtgtgtagccgaggtgaacaatattgatccatttgttagcgcatcaacagtccaaacgggtattaacatagctggtagaatactaggcgtattaggggtgccgtttgctggacaactagctagtttttatagttttcttgttggggaattatggcctagcggcagagatccatgggaaatttttatggaacatgtcgagcaaattgtaagacaacaaataacggacagtgttagggataccgctattgctcgtttagaaggtctaggaagagggtatagatcttaccagcaggctcttgaaacttggttagataaccgaaatgatgcaagatcaagaagcattattcttgagcgctatattgctttagaacttgacattactactgctataccgcttttcagcatacgaaatcaagaggttccattattgatggtatatgctcaagctgcaaatttacacctattattattgagagacgcatccctttttggtagtgaatgggggatggcatcttccgatgttaaccaatattaccaagaacaaatcagatatacagaggaatattctaaccattgcgtacaatggtataatacagggctaaataacttaagagggacaaatgctgaaagttggttgcggtataatcaattccgtagagacctaacgttaggggtattagatttagtagccctattcccaagctatgatactcgcacttatccaatcaatacgagtgctcagttaacaagagaaatttatacagatccaattgggagaacaaatgcaccttcaggatttgcaagtacgaattggtttaataataatgcaccatcgttttctgccatagaggctgccattttcaggcctccgcatctacttgattttccagaacaacttacaatttacagtgcatcaagccgttggagtagcactcaacatatgaattattgggtgggacataggcttaacttccgcccaataggagggacattaaatacctcaacacaaggacttactaataatacttcaattaatcctgtaacattacagtttacgtctcgtgacgtttatagaacagaatcaaatgcagggacaaatatactatttactactcctgtgaatggagtaccttgggctagatttaattttataaaccctcagaatatttatgaaagaggcgccactacctacagtcaaccgtatcagggagttgggattcaattatttgattcagaaactgaattaccaccagaaacaacagaacgaccaaattatgaatcatatagtcatagattatctcatataggactaatcataggaaacactttgagagcaccagtctattcttggacgcatcgtagtgcaactcttacaaatacaattgatccagagagaattaatcaaatacctttagtgaaaggatttagagtttgggggggcacctctgtcattacaggaccaggatttacaggaggggatatccttcgaagaaatacctttggtgattttgtatctctacaagtcaatattaattcaccaattacccaaagataccgtttaagatttcgttacgcttccagtagggatgcacgagttatagtattaacaggagcggcatccacaggagtgggaggccaagttagtgtaaatatgcctcttcagaaaactatggaaataggggagaacttaacatctagaacatttagatataccgattttagtaatcctttttcatttagagctaatccagatataattgggataagtgaacaacctctatttggtgcaggttctattagtagcggtgaactttatatagataaaattgaaattattctagcagatgcaacatttgaagcagaatctgatttagagaaagctcagaaa

SEQ ID NO: 29 - protein, 663 aa, Artificial Sequence
  Cry1B variant
MPSNRKNENEIINAVSNHSAQMDLSLDARIEDSLCVAEVNNIDPFVSASTVQTGISIAGRILGVLGVPFAGQLASFYSFLVGELWPSGRDPWEIFLEHVEQLIRQQVTENTRNTAIARLEGLGRGYRSYQQALETWLDNRNDARSRSIILERYVALELDITTAIPLFSIRNQEVPLLMVYAQAANLHLLLLRDASLFGSEWGMSSADVNQYYQEQIRYTEEYSNHCVQWYNTGLNNLRGTNAESWLRYNQFRRDLTLGVLDLVALFPSYDTRTYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTQGLTNNTSINPVTLQFTSRDVYRTESNAGTNILFTTPVNGVPWARFNFINPQNIYERGATTYSQPYQGVGIQLFDSETELPPETTERPNYESYSHRLSHIGLIIGNTLRAPVYSWTHRSATLTNTIDPERINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQK

SEQ ID NO: 30 - DNA, 1989 bp, Artificial Sequence
  coding sequence of Cry1B variant
atgccttcaaataggaaaaatgagaatgaaattataaatgctgtatcgaatcattccgcacaaatggatctatcgctagatgctcgtattgaagatagcttgtgtgtagccgaggtgaacaatattgatccatttgttagcgcatcaacagtccaaacaggtattagtatagctggtagaatattgggcgtattaggtgtgccgtttgctggacaactagctagtttttatagttttcttgttggggaattatggcctagcggcagagatccatgggaaattttcctggaacatgtcgaacaacttataagacaacaagtaacagaaaatactaggaatacggctattgctcgattagaaggtctaggaagaggctatagatcttaccagcaggctcttgaaacttggttagataaccgaaatgatgcaagatcaagaagcattattcttgagcgctatgttgctttagaacttgacattactactgctataccgcttttcagcatacgaaatcaagaggttccattattaatggtatatgctcaagctgcaaatttacacctattattattgagagacgcatccctttttggtagtgaatgggggatgtcatctgccgatgttaaccaatattaccaagaacaaatcagatatacagaggaatattctaaccattgcgtacaatggtataatacagggctaaataacttaagagggacaaatgctgaaagttggttgcggtataatcaattccgtagagacctaacgttaggggtattagatttagtagccctattcccaagctatgacactcgcacttatccaatcaatacgagtgctcagttaacaagagaaatttatacagatccaattgggagaacaaatgcaccttcaggatttgcaagtacgaattggtttaataataatgcaccatcgttttctgccatagaggctgccattttcaggcctccgcatctacttgattttccagaacaacttacaatttacagtgcatcaagccgttggagtagcactcaacatatgaattattgggtgggacataggcttaacttccgcccaataggagggacattaaatacctcaacacaaggacttactaataatacttcaattaatcctgtaacattacagtttacgtctcgtgacgtttatagaacagaatcaaatgcagggacaaatatactatttactactcctgtgaatggagtaccttgggctagatttaattttataaaccctcagaatatttatgaaagaggcgccactacctacagtcaaccgtatcagggagttgggattcaattatttgattcagaaactgaattaccaccagaaacaacagaacgaccaaattatgaatcatatagtcatagattatctcatataggactaatcataggaaacactttgagagcaccagtctattcttggacgcatcgtagtgcaactcttacaaatacaattgatccagagagaattaatcaaatacctttagtgaaaggatttagagtttgggggggcacctctgtcattacaggaccaggatttacaggaggggatatccttcgaagaaatacctttggtgattttgtatctctacaagtcaatattaattcaccaattacccaaagataccgtttaagatttcgttacgcttccagtagggatgcacgagttatagtattaacaggagcggcatccacaggagtgggaggccaagttagtgtaaatatgcctcttcagaaaactatggaaataggggagaacttaacatctagaacatttagatataccgattttagtaatcctttttcatttagagctaatccagatataattgggataagtgaacaacctctatttggtgcaggttctattagtagcggtgaactttatatagataaaattgaaattattctagcagatgcaacatttgaagcagaatctgatttagaaagagcacaaaag

SEQ ID NO: 31 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITENARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIHGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIISNTLRAPVYSWTHRSADRTNTIATNIITQIPAVKGNFLFNGSVISGPGFTGGDLVRLNNSGNNIYNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 32 - DNA, 1968 bp, Artificial Sequence
  coding sequence of Cry1B variant
atgccctccaaccgcaagaacgagaacgagataatcaacgccctgtcgatcccagccgtctccaaccactccgcgcagatggacctctcactggacgctcgcatcgaggactcactctgcatcgccgagggcaacaacatcaacccgctcgtcagcgcctcgaccgtgcagactggcatcaacatcgccggtcgcatactcggcgtcctcggagtcccattcgcaggtcagctggcgagcttctacagcttcatcgtcggcgagctctggccatcaggtcgcgatccctgggagatcttcatggagcacgtcgagcagctggtcaggcagcacatcacggagaacgctcgcaacacggctctcgccagactccaaggcctcggagccagcttcagagcctaccagcagtccctcgaggactggctcgagaaccgcgacaacgcgaggacccggagcgtcctctacacccagtacatcgcgctggagctcgacttcctgaacgcgatgccactcttcgccatcaacaaccagcaggtgccgctcctcatggtctacgcccaagctgccaacctccacctcctgctcctcagagacgctagcctgttcggcagcgagttcggactcacgtcgcaggagatccagcgctactacgagcgccaggcggagaagacccgggagtacagcgactactgcgcacgctggtacaacaccggcctgaacaacctgcgcggcacgaacgctgagagctggctccgctacaaccagttccgcagggacctcacactcggagtcctcgacctcgtcgcgctgttcccgagctacgacacgcggatctacccgatcaacacgagcgcgcagctcactcgcgagatctacacggaccccatcggtcgcacgaacgctccatccggcttcgcctccaccaactggttcaacaacaacgcgccgtcgttcagcgccatcgaagctgcaatcttccgcccacctcacctgctggacttcccagagcagctcaccatctacagcgcctccagccgctggtccagcacgcagcacatgaactactgggtcggccaccgcctcaacttcaggcctatccacggtaccctcaacacctcgacccacggcgccacgaacacgtccatcaacccggtgacgctccagttcacgagccgggacgtctaccgcactgagagctacgctggcatcaacatcctgctcacgacgccagtgaacggcgtcccgtgggcacgcttcaactggaggaaccctctcaactccctgcgcggatcgctcctctacaccatcggctacaccggagtcggtacccagctcttcgacagcgagaccgagctcccacctgagaccaccgagaggcccaactacgagagctactcccaccgcctgtcgaacatccgcctcatcatctccaacacgctcagagctcccgtctactcctggacgcacaggtcagctgaccggacgaacaccatcgcgacgaacatcatcacccagatcccggccgtcaagggcaacttcctcttcaacggctccgtcatctccggaccaggcttcaccggaggagacctcgtccgcctcaacaactccggcaacaacatctacaaccggggctacatcgaggtgccgatccagttcatctccacgagcactcggtaccgcgtcagagtgcgctacgcgagcgtcactccgatccgcctctccgtcaactggggcaactcgaacatcttcagctccatcgtcccagccaccgcgactagcctcgacaacctgcagtcccgcaacttcggctacttcgagagccgcaacgccttcacgagcgcgactggcaacgtcgtcggcgtccgcaacttctccgagaacgccggagtgatcatcgaccgcttcgagttcatccccgtgaccgcgaccttcgaggccgagtacgaccttgagagagctcaggaggcc

SEQ ID NO: 33 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITENARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIHGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGNTLRAPVYSWTHRSADRTNTIATNIITQIPAVKGNFLFNGSVISGPGFTGGDLVRLNNSGNNIYNRGYIEVPIQFISTSTRYRVRVRYASVTPIRLSVNWGNSNIFSTIVPATATSLDNLQSRNFGYFESRNAFTSATGNVVGVRNFSENAGVIIDRFEFIPVTATFEAEYDLERAQE

SEQ ID NO: 34 - DNA, 1968 bp, Artificial Sequence
  coding sequence of Cry1B variant
atgccctccaaccgcaagaacgagaacgagataatcaacgccctgtcgatcccagccgtctccaaccactccgcgcagatggacctctcactggacgctcgcatcgaggactcactctgcatcgccgagggcaacaacatcaacccgctcgtcagcgcctcgaccgtgcagactggcatcaacatcgccggtcgcatactcggcgtcctcggagtcccattcgcaggtcagctggcgagcttctacagcttcatcgtcggcgagctctggccatcaggtcgcgatccctgggagatcttcatggagcacgtcgagcagctggtcaggcagcacatcacggagaacgctcgcaacacggctctcgccagactccaaggcctcggagccagcttcagagcctaccagcagtccctcgaggactggctcgagaaccgcgacaacgcgaggacccggagcgtcctctacacccagtacatcgcgctggagctcgacttcctgaacgcgatgccactcttcgccatcaacaaccagcaggtgccgctcctcatggtctacgcccaagctgccaacctccacctcctgctcctcagagacgctagcctgttcggcagcgagttcggactcacgtcgcaggagatccagcgctactacgagcgccaggcggagaagacccgggagtacagcgactactgcgcacgctggtacaacaccggcctgaacaacctgcgcggcacgaacgctgagagctggctccgctacaaccagttccgcagggacctcacactcggagtcctcgacctcgtcgcgctgttcccgagctacgacacgcggatctacccgatcaacacgagcgcgcagctcactcgcgagatctacacggaccccatcggtcgcacgaacgctccatccggcttcgcctccaccaactggttcaacaacaacgcgccgtcgttcagcgccatcgaagctgcaatcttccgcccacctcacctgctggacttcccagagcagctcaccatctacagcgcctccagccgctggtccagcacgcagcacatgaactactgggtcggccaccgcctcaacttcaggcctatccacggtaccctcaacacctcgacccacggcgccacgaacacgtccatcaacccggtgacgctccagttcacgagccgggacgtctaccgcactgagagctacgctggcatcaacatcctgctcacgacgccagtgaacggcgtcccgtgggcacgcttcaactggaggaaccctctcaactccctgcgcggatcgctcctctacaccatcggctacaccggagtcggtacccagctcttcgacagcgagaccgagctcccacctgagaccaccgagaggcccaactacgagagctactcccaccgcctgtcgaacatccgcctcatcatcggcaacacgctcagagctcccgtctactcctggacgcacaggtcagctgaccggacgaacaccatcgcgacgaacatcatcacccagatcccggccgtcaagggcaacttcctcttcaacggctccgtcatctccggaccaggcttcaccggaggagacctcgtccgcctcaacaactccggcaacaacatctacaaccggggctacatcgaggtgccgatccagttcatctccacgagcactcggtaccgcgtcagagtgcgctacgcgagcgtcactccgatccgcctctccgtcaactggggcaactcgaacatcttcagcaccatcgtcccagccaccgcgactagcctcgacaacctgcagtcccgcaacttcggctacttcgagagccgcaacgccttcacgagcgcgactggcaacgtcgtcggcgtccgcaacttctccgagaacgccggagtgatcatcgaccgcttcgagttcatccccgtgaccgcgaccttcgaggccgagtacgaccttgagagagctcaggaggcc

SEQ ID NO: 35 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQMITLNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGSVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 36 - DNA, 1968 bp, Artificial Sequence
  coding sequence of Cry1B variant
atgccctccaaccgcaagaacgagaacgagataatcaacgccctgtcgatcccagccgtctccaaccactccgcgcagatggacctctcactggacgctcgcatcgaggactcactctgcatcgccgagggcaacaacatcaacccgctcgtcagcgcctcgaccgtgcagactggcatcaacatcgccggtcgcatactcggcgtcctcggagtcccattcgcaggtcagctggcgagcttctacagcttcatcgtcggcgagctctggccatcaggtcgcgatccctgggagatcttcatggagcacgtcgagcagctggtcaggcagatgatcacgctcaacgctcgcaacacggctctcgccagactccaaggcctcggagccagcttcagagcctaccagcagtccctcgaggactggctcgagaaccgcgacaacgcgaggacccggagcgtcctctacacccagtacatcgcgctggagctcgacttcctgaacgcgatgccactcttcgccatcaacaaccagcaggtgccgctcctcatggtctacgcccaagctgccaacctccacctcctgctcctcagagacgctagcctgttcggcagcgagttcggactcacgtcgcaggagatccagcgctactacgagcgccaggcggagaagacccgggagtacagcgactactgcgcacgctggtacaacaccggcctgaacaacctgcgcggcacgaacgctgagagctggctccgctacaaccagttccgcagggacctcacactcggagtcctcgacctcgtcgcgctgttcccgagctacgacacgcggatctacccgatcaacacgagcgcgcagctcactcgcgagatctacacggaccccatcggtcgcacgaacgctccatccggcttcgcctccaccaactggttcaacaacaacgcgccgtcgttcagcgccatcgaagctgcaatcttccgcccacctcacctgctggacttcccagagcagctcaccatctacagcgcctccagccgctggtccagcacgcagcacatgaactactgggtcggccaccgcctcaacttcaggcctatcggcggtaccctcaacacctcgacccacggcgccacgaacacgtccatcaacccggtgacgctccagttcacgagccgggacgtctaccgcactgagagctacgctggcatcaacatcctgctcacgacgccagtgaacggcgtcccgtgggcacgcttcaactggaggaaccctctcaactccctgcgcggatcgctcctctacaccatcggctacaccggagtcggtacccagctcttcgacagcgagaccgagctcccacctgagaccaccgagaggcccaactacgagagctactcccaccgcctgtcgaacatccgcctcatcatcggcggcacgctcagagctcccgtctactcctggacgcacaggtcagctgaccggacgaacaccatcgcgacgaacatcatcacccagatcccggccgtcaagggcaacttcctcttcaacggctccgtcatctccggaccaggcttcaccggaggagacctcgtccgcctcaacaactccggcaacaacatccagaaccggggctacatcgaggtgccgatccagttcatctccacgagcactcggtaccgcgtcagagtgcgctacgcgagcgtcactccgatccgcctctccgtcaactggggcaactcgaacatcttcagctccatcgtcccagccaccgcgactagcctcgacaacctgcagtcccgcaacttcggctacttcgagagccgcaacgccttcacgagcgcgactggcaacgtcgtcggcgtccgcaacttctccgagaacgccggagtgatcatcgaccgcttcgagttcatccccgtgaccgcgaccttcgaggccgagtacgaccttgagagagctcaggaggcc

SEQ ID NO: 37 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQMITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGSVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 38 - DNA, 1968 bp, Artificial Sequence
  coding sequence of Cry1B variant
atgccctccaaccgcaagaacgagaacgagataatcaacgccctgtcgatcccagccgtctccaaccactccgcgcagatggacctctcactggacgctcgcatcgaggactcactctgcatcgccgagggcaacaacatcaacccgctcgtcagcgcctcgaccgtgcagactggcatcaacatcgccggtcgcatactcggcgtcctcggagtcccattcgcaggtcagctggcgagcttctacagcttcatcgtcggcgagctctggccatcaggtcgcgatccctgggagatcttcatggagcacgtcgagcagctggtcaggcagatgatcacgatgaacgctcgcaacacggctctcgccagactccaaggcctcggagccagcttcagagcctaccagcagtccctcgaggactggctcgagaaccgcgacaacgcgaggacccggagcgtcctctacacccagtacatcgcgctggagctcgacttcctgaacgcgatgccactcttcgccatcaacaaccagcaggtgccgctcctcatggtctacgcccaagctgccaacctccacctcctgctcctcagagacgctagcctgttcggcagcgagttcggactcacgtcgcaggagatccagcgctactacgagcgccaggcggagaagacccgggagtacagcgactactgcgcacgctggtacaacaccggcctgaacaacctgcgcggcacgaacgctgagagctggctccgctacaaccagttccgcagggacctcacactcggagtcctcgacctcgtcgcgctgttcccgagctacgacacgcggatctacccgatcaacacgagcgcgcagctcactcgcgagatctacacggaccccatcggtcgcacgaacgctccatccggcttcgcctccaccaactggttcaacaacaacgcgccgtcgttcagcgccatcgaagctgcaatcttccgcccacctcacctgctggacttcccagagcagctcaccatctacagcgcctccagccgctggtccagcacgcagcacatgaactactgggtcggccaccgcctcaacttcaggcctatcggcggtaccctcaacacctcgacccacggcgccacgaacacgtccatcaacccggtgacgctccagttcacgagccgggacgtctaccgcactgagagctacgctggcatcaacatcctgctcacgacgccagtgaacggcgtcccgtgggcacgcttcaactggaggaaccctctcaactccctgcgcggatcgctcctctacaccatcggctacaccggagtcggtacccagctcttcgacagcgagaccgagctcccacctgagaccaccgagaggcccaactacgagagctactcccaccgcctgtcgaacatccgcctcatcatcggcggcacgctcagagctcccgtctactcctggacgcacaggtcagctgaccggacgaacaccatcgcgacgaacatcatcacccagatcccggccgtcaagggcaacttcctcttcaacggctccgtcatctccggaccaggcttcaccggaggagacctcgtccgcctcaacaactccggcaacaacatccagaaccggggctacatcgaggtgccgatccagttcatctccacgagcactcggtaccgcgtcagagtgcgctacgcgagcgtcactccgatccgcctctccgtcaactggggcaactcgaacatcttcagctccatcgtcccagccaccgcgactagcctcgacaacctgcagtcccgcaacttcggctacttcgagagccgcaacgccttcacgagcgcgactggcaacgtcgtcggcgtccgcaacttctccgagaacgccggagtgatcatcgaccgcttcgagttcatccccgtgaccgcgaccttcgaggccgagtacgaccttgagagagctcaggaggcc

SEQ ID NO: 39 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQMITHNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGSVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 40 - DNA, 1968 bp, Artificial Sequence
  coding sequence of Cry1B variant
atgccctccaaccgcaagaacgagaacgagataatcaacgccctgtcgatcccagccgtctccaaccactccgcgcagatggacctctcactggacgctcgcatcgaggactcactctgcatcgccgagggcaacaacatcaacccgctcgtcagcgcctcgaccgtgcagactggcatcaacatcgccggtcgcatactcggcgtcctcggagtcccattcgcaggtcagctggcgagcttctacagcttcatcgtcggcgagctctggccatcaggtcgcgatccctgggagatcttcatggagcacgtcgagcagctggtcaggcagatgatcacgcacaacgctcgcaacacggctctcgccagactccaaggcctcggagccagcttcagagcctaccagcagtccctcgaggactggctcgagaaccgcgacaacgcgaggacccggagcgtcctctacacccagtacatcgcgctggagctcgacttcctgaacgcgatgccactcttcgccatcaacaaccagcaggtgccgctcctcatggtctacgcccaagctgccaacctccacctcctgctcctcagagacgctagcctgttcggcagcgagttcggactcacgtcgcaggagatccagcgctactacgagcgccaggcggagaagacccgggagtacagcgactactgcgcacgctggtacaacaccggcctgaacaacctgcgcggcacgaacgctgagagctggctccgctacaaccagttccgcagggacctcacactcggagtcctcgacctcgtcgcgctgttcccgagctacgacacgcggatctacccgatcaacacgagcgcgcagctcactcgcgagatctacacggaccccatcggtcgcacgaacgctccatccggcttcgcctccaccaactggttcaacaacaacgcgccgtcgttcagcgccatcgaagctgcaatcttccgcccacctcacctgctggacttcccagagcagctcaccatctacagcgcctccagccgctggtccagcacgcagcacatgaactactgggtcggccaccgcctcaacttcaggcctatcggcggtaccctcaacacctcgacccacggcgccacgaacacgtccatcaacccggtgacgctccagttcacgagccgggacgtctaccgcactgagagctacgctggcatcaacatcctgctcacgacgccagtgaacggcgtcccgtgggcacgcttcaactggaggaaccctctcaactccctgcgcggatcgctcctctacaccatcggctacaccggagtcggtacccagctcttcgacagcgagaccgagctcccacctgagaccaccgagaggcccaactacgagagctactcccaccgcctgtcgaacatccgcctcatcatcggcggcacgctcagagctcccgtctactcctggacgcacaggtcagctgaccggacgaacaccatcgcgacgaacatcatcacccagatcccggccgtcaagggcaacttcctcttcaacggctccgtcatctccggaccaggcttcaccggaggagacctcgtccgcctcaacaactccggcaacaacatccagaaccggggctacatcgaggtgccgatccagttcatctccacgagcactcggtaccgcgtcagagtgcgctacgcgagcgtcactccgatccgcctctccgtcaactggggcaactcgaacatcttcagctccatcgtcccagccaccgcgactagcctcgacaacctgcagtcccgcaacttcggctacttcgagagccgcaacgccttcacgagcgcgactggcaacgtcgtcggcgtccgcaacttctccgagaacgccggagtgatcatcgaccgcttcgagttcatccccgtgaccgcgaccttcgaggccgagtacgaccttgagagagctcaggaggcc

SEQ ID NO: 41 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGSVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 42 - DNA, 1968 bp, Artificial Sequence
  coding sequence of Cry1B variant
atgccctccaaccgcaagaacgagaacgagataatcaacgccctgtcgatcccagccgtctccaaccactccgcgcagatggacctctcactggacgctcgcatcgaggactcactctgcatcgccgagggcaacaacatcaacccgctcgtcagcgcctcgaccgtgcagactggcatcaacatcgccggtcgcatactcggcgtcctcggagtcccattcgcaggtcagctggcgagcttctacagcttcatcgtcggcgagctctggccatcaggtcgcgatccctgggagatcttcatggagcacgtcgagcagctggtcaggcagcacatcacgatgaacgctcgcaacacggctctcgccagactccaaggcctcggagccagcttcagagcctaccagcagtccctcgaggactggctcgagaaccgcgacaacgcgaggacccggagcgtcctctacacccagtacatcgcgctggagctcgacttcctgaacgcgatgccactcttcgccatcaacaaccagcaggtgccgctcctcatggtctacgcccaagctgccaacctccacctcctgctcctcagagacgctagcctgttcggcagcgagttcggactcacgtcgcaggagatccagcgctactacgagcgccaggcggagaagacccgggagtacagcgactactgcgcacgctggtacaacaccggcctgaacaacctgcgcggcacgaacgctgagagctggctccgctacaaccagttccgcagggacctcacactcggagtcctcgacctcgtcgcgctgttcccgagctacgacacgcggatctacccgatcaacacgagcgcgcagctcactcgcgagatctacacggaccccatcggtcgcacgaacgctccatccggcttcgcctccaccaactggttcaacaacaacgcgccgtcgttcagcgccatcgaagctgcaatcttccgcccacctcacctgctggacttcccagagcagctcaccatctacagcgcctccagccgctggtccagcacgcagcacatgaactactgggtcggccaccgcctcaacttcaggcctatcggcggtaccctcaacacctcgacccacggcgccacgaacacgtccatcaacccggtgacgctccagttcacgagccgggacgtctaccgcactgagagctacgctggcatcaacatcctgctcacgacgccagtgaacggcgtcccgtgggcacgcttcaactggaggaaccctctcaactccctgcgcggatcgctcctctacaccatcggctacaccggagtcggtacccagctcttcgacagcgagaccgagctcccacctgagaccaccgagaggcccaactacgagagctactcccaccgcctgtcgaacatccgcctcatcatcggcggcacgctcagagctcccgtctactcctggacgcacaggtcagctgaccggacgaacaccatcgcgacgaacatcatcacccagatcccggccgtcaagggcaacttcctcttcaacggctccgtcatctccggaccaggcttcaccggaggagacctcgtccgcctcaacaactccggcaacaacatccagaaccggggctacatcgaggtgccgatccagttcatctccacgagcactcggtaccgcgtcagagtgcgctacgcgagcgtcactccgatccgcctctccgtcaactggggcaactcgaacatcttcagctccatcgtcccagccaccgcgactagcctcgacaacctgcagtcccgcaacttcggctacttcgagagccgcaacgccttcacgagcgcgactggcaacgtcgtcggcgtccgcaacttctccgagaacgccggagtgatcatcgaccgcttcgagttcatccccgtgaccgcgaccttcgaggccgagtacgaccttgagagagctcaggaggcc

SEQ ID NO: 43 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQMITHNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPINGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGNTLRAPVYSWTHRSADRTNTIATNIITQIPAVKGNFLFNGSVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 44 - DNA, 1968 bp, Artificial Sequence
  coding sequence of Cry1B variant
atgccctccaaccgcaagaacgagaacgagataatcaacgccctgtcgatcccagccgtctccaaccactccgcgcagatggacctctcactggacgctcgcatcgaggactcactctgcatcgccgagggcaacaacatcaacccgctcgtcagcgcctcgaccgtgcagactggcatcaacatcgccggtcgcatactcggcgtcctcggagtcccattcgcaggtcagctggcgagcttctacagcttcatcgtcggcgagctctggccatcaggtcgcgatccctgggagatcttcatggagcacgtcgagcagctggtcaggcagatgatcacgcacaacgctcgcaacacggctctcgccagactccaaggcctcggagccagcttcagagcctaccagcagtccctcgaggactggctcgagaaccgcgacaacgcgaggacccggagcgtcctctacacccagtacatcgcgctggagctcgacttcctgaacgcgatgccactcttcgccatcaacaaccagcaggtgccgctcctcatggtctacgcccaagctgccaacctccacctcctgctcctcagagacgctagcctgttcggcagcgagttcggactcacgtcgcaggagatccagcgctactacgagcgccaggcggagaagacccgggagtacagcgactactgcgcacgctggtacaacaccggcctgaacaacctgcgcggcacgaacgctgagagctggctccgctacaaccagttccgcagggacctcacactcggagtcctcgacctcgtcgcgctgttcccgagctacgacacgcggatctacccgatcaacacgagcgcgcagctcactcgcgagatctacacggaccccatcggtcgcacgaacgctccatccggcttcgcctccaccaactggttcaacaacaacgcgccgtcgttcagcgccatcgaagctgcaatcttccgcccacctcacctgctggacttcccagagcagctcaccatctacagcgcctccagccgctggtccagcacgcagcacatgaactactgggtcggccaccgcctcaacttcaggcctatcaacggtaccctcaacacctcgacccacggcgccacgaacacgtccatcaacccggtgacgctccagttcacgagccgggacgtctaccgcactgagagctacgctggcatcaacatcctgctcacgacgccagtgaacggcgtcccgtgggcacgcttcaactggaggaaccctctcaactccctgcgcggatcgctcctctacaccatcggctacaccggagtcggtacccagctcttcgacagcgagaccgagctcccacctgagaccaccgagaggcccaactacgagagctactcccaccgcctgtcgaacatccgcctcatcatcggcaacacgctcagagctcccgtctactcctggacgcacaggtcagctgaccggacgaacaccatcgcgacgaacatcatcacccagatcccggccgtcaagggcaacttcctcttcaacggctccgtcatctccggaccaggcttcaccggaggagacctcgtccgcctcaacaactccggcaacaacatccagaaccggggctacatcgaggtgccgatccagttcatctccacgagcactcggtaccgcgtcagagtgcgctacgcgagcgtcactccgatccgcctctccgtcaactggggcaactcgaacatcttcagctccatcgtcccagccaccgcgactagcctcgacaacctgcagtcccgcaacttcggctacttcgagagccgcaacgccttcacgagcgcgactggcaacgtcgtcggcgtccgcaacttctccgagaacgccggagtgatcatcgaccgcttcgagttcatccccgtgaccgcgaccttcgaggccgagtacgaccttgagagagctcaggaggcc

SEQ ID NO: 45 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPINGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGNTLRAPVYSWTHRSADRTNTIATNIITQIPAVKGNFLFNGSVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 46 - DNA, 1968 bp, Artificial Sequence
  coding sequence of Cry1B variant
atgccctccaaccgcaagaacgagaacgagataatcaacgccctgtcgatcccagccgtctccaaccactccgcgcagatggacctctcactggacgctcgcatcgaggactcactctgcatcgccgagggcaacaacatcaacccgctcgtcagcgcctcgaccgtgcagactggcatcaacatcgccggtcgcatactcggcgtcctcggagtcccattcgcaggtcagctggcgagcttctacagcttcatcgtcggcgagctctggccatcaggtcgcgatccctgggagatcttcatggagcacgtcgagcagctggtcaggcagcacatcacgatgaacgctcgcaacacggctctcgccagactccaaggcctcggagccagcttcagagcctaccagcagtccctcgaggactggctcgagaaccgcgacaacgcgaggacccggagcgtcctctacacccagtacatcgcgctggagctcgacttcctgaacgcgatgccactcttcgccatcaacaaccagcaggtgccgctcctcatggtctacgcccaagctgccaacctccacctcctgctcctcagagacgctagcctgttcggcagcgagttcggactcacgtcgcaggagatccagcgctactacgagcgccaggcggagaagacccgggagtacagcgactactgcgcacgctggtacaacaccggcctgaacaacctgcgcggcacgaacgctgagagctggctccgctacaaccagttccgcagggacctcacactcggagtcctcgacctcgtcgcgctgttcccgagctacgacacgcggatctacccgatcaacacgagcgcgcagctcactcgcgagatctacacggaccccatcggtcgcacgaacgctccatccggcttcgcctccaccaactggttcaacaacaacgcgccgtcgttcagcgccatcgaagctgcaatcttccgcccacctcacctgctggacttcccagagcagctcaccatctacagcgcctccagccgctggtccagcacgcagcacatgaactactgggtcggccaccgcctcaacttcaggcctatcaacggtaccctcaacacctcgacccacggcgccacgaacacgtccatcaacccggtgacgctccagttcacgagccgggacgtctaccgcactgagagctacgctggcatcaacatcctgctcacgacgccagtgaacggcgtcccgtgggcacgcttcaactggaggaaccctctcaactccctgcgcggatcgctcctctacaccatcggctacaccggagtcggtacccagctcttcgacagcgagaccgagctcccacctgagaccaccgagaggcccaactacgagagctactcccaccgcctgtcgaacatccgcctcatcatcggcaacacgctcagagctcccgtctactcctggacgcacaggtcagctgaccggacgaacaccatcgcgacgaacatcatcacccagatcccggccgtcaagggcaacttcctcttcaacggctccgtcatctccggaccaggcttcaccggaggagacctcgtccgcctcaacaactccggcaacaacatccagaaccggggctacatcgaggtgccgatccagttcatctccacgagcactcggtaccgcgtcagagtgcgctacgcgagcgtcactccgatccgcctctccgtcaactggggcaactcgaacatcttcagctccatcgtcccagccaccgcgactagcctcgacaacctgcagtcccgcaacttcggctacttcgagagccgcaacgccttcacgagcgcgactggcaacgtcgtcggcgtccgcaacttctccgagaacgccggagtgatcatcgaccgcttcgagttcatccccgtgaccgcgaccttcgaggccgagtacgaccttgagagagctcaggaggcc

SEQ ID NO: 47 - protein, 655 aa, Bacillus thuringiensis
MTSNRKNENEIINALSIPAVSNHSAQMDLSPDARIEDSLCIAEGNNINPLVSASTVQTGINIAGRILGVLGVPFAGQLASFYSFIVGELWPSGRDPWEIFLEHVEQLVRQQITENARNTALARLQGLGASFRAYQQSLEDWLENRDDARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESYAGINILLTTPVNGVPWARFNWRNPLNSLRGSLLYTIGYTGVGTQLFDSETELPPETTERPNYESYSHRLSNIRLISGNTLRAPVYSWTHRSADRTNTIATNIITQIPAVKGNFLFNGSVISGPGFTGGDLVRLNNSGNNIQNRGYLEVPIQFISTSTRYRVRVRYASVTPIQLSVNWGNSNIFSSIVPATATSLDNLQSRDFGYFESTNAFTSATGNVVGVRNFSENAGVIIDRFEFIPVTATFEAEYDLERAQE

SEQ ID NO: 48 - DNA, 1965 bp, Bacillus thuringiensis
atgacttcaaataggaaaaatgagaatgaaattataaatgctttatcgattccagctgtatcgaatcattccgcacaaatggatctatcaccagatgctcgtattgaggattctttgtgtatagccgaggggaataatatcaatccacttgttagcgcatcaacagtccaaacgggtattaacattgctggtagaatactaggcgtattaggcgtaccgtttgctggacaactagctagtttttatagttttattgtcggtgaattatggcctagcggcagagatccgtgggaaatctttctagaacatgttgaacaacttgtaagacaacaaataacagaaaatgctaggaatacggcacttgctcgattacaaggtttaggagcttcctttagagcctatcaacaatcacttgaagactggctagaaaaccgtgatgatgcaagaacgagaagtgttctttatacccaatatatagccttagagcttgattttcttaatgcgatgccgcttttcgcaataaacaatcaacaggttccattattgatggtatatgctcaagctgcaaatttacatctattattattgagagatgcctctctttttggtagtgaatttgggcttacatcgcaggaaattcaacgttattatgagcgccaagcggaaaaaacgagagaatattctgattattgcgcaagatggtataatacgggtttaaataatttgagagggacaaatgctgaaagttggttgcgatataatcaattccgtagagacttaacgctaggagtattagatctagtggcactattcccaagctatgacacgcgtatttatccaataaataccagtgctcaattaacaagagaaatttatacagatccaattgggagaacaaatgcaccttcaggatttgcaagtacgaattggtttaataataatgcaccatcgttttctgccatagaggctgccgttattaggcctccgcatctacttgattttccagaacagcttacaattttcagcgtattaagtcgatggagtaatactcaatatatgaattactgggtgggacatagacttgaatcgcgaacaataagggggtcattaagtacctcgacacacggaaataccaatacttctattaatcctgtaacattacagttcacatctcgtgacgtttatagaacagaatcatatgcagggataaatatacttctaactactcctgtgaatggagtaccttgggctagatttaattggagaaatcccctgaattctcttagaggtagccttctctatactatagggtatactggagtggggacacaactatttgattcagaaactgaattaccaccagaaacaacagaacgaccaaattatgaatcttacagtcatagattatctaatataagactaatatcaggaaacactttgagagcaccagtatattcttggacgcaccgtagtgcagatcgtacgaatacgattgctacaaatattattactcaaattcctgcagtgaagggaaactttctttttaatggttctgtaatttcaggaccaggatttactggtggggacttagttagattaaataatagtggaaataatattcaaaatagaggctaccttgaggttccgattcaattcatctccacatctaccagatatcgagttcgtgtacgttatgcttctgtaaccccgattcaactcagtgttaattggggtaattcaaacattttttccagcatagtaccagctacagctacgtcattagataatctacaatcaagggattttggttattttgaaagtaccaatgcatttacatctgcaacaggtaatgtagtaggtgttagaaattttagtgagaatgcaggagtgataatagacagatttgaatttatcccagttactgcaaccttcgaagcagaatatgatttagaaagagcgcaagag

SEQ ID NO: 49 - protein, 650 aa, Bacillus thuringiensis
MPSNRKNENEIINALSIPAVSNHSAQMDLSPDARIEDSLCVAEGNNIDPFVSASTVQTGISIAGRILGVLGVPFAGQLASFYSFLVGELWPSGRDPWEIFMEHVEQIVRQQITDSVRDTAIARLEGLGRGYRSYQQALETWLDNRNDARSRSIIRERYIALELDITTAIPLFSIRNQEVPLLMVYAQAANLHLLLLRDASLFGSEWGMSSADVNQYYQEQIRYTEEYSNHCVQWYNTGLNRLRGTTAESWVRYNQFRRDLTLGVLDLVALFPSYDTRTYPIPTTAQLTREVYTDPNGVVAGPNNSWFRNGASFSAIENAIIRQPHLYDFLTNLTIYTRRSQVGTTIMNLWAGHRITFNRIQGGSTSEMVYGAITNPVSVSDIPFVNRDVYRTVSLAGGLGSLSGIRYGLTRVDFDMIFRNHPDIVTGLFYHPGHAGIATQVKDSETELPPETTEQPNYRAFSHLLSHISMGPTTQDVPPVYSWTHQSADRTNTINSDRITQIPLVKAHTLQSGTTVVKGPGFTGGDILRRTSGGPFAFSNVNLDFNLSQRYRARIRYASTTNLRIYVTVAGERIFAGQFDKTMDAGAPLTFQSFSYATINTAFTFPERSSSLTVGADTFSSGNEVYVDRFELIPVTATFEAESDLERARK

SEQ ID NO: 50 - DNA, 1950 bp, Bacillus thuringiensis
atgccttcaaataggaaaaatgagaatgaaattataaatgctttatcgattccagctgtatcgaatcattccgcacaaatggatctatcaccagatgctcgcattgaggatagcttgtgtgtagccgaggggaacaatattgatccatttgttagcgcatcaacagtccaaacaggtattagtatagctggtagaatattaggcgtattaggggtgccgtttgccggacaactagctagtttttatagttttcttgttggggaattatggcctagcggcagagatccatgggaaatttttatggaacatgtcgaacaaattgtaagacaacaaataacggacagtgttagggataccgctattgctcgtttagaaggtctaggaagagggtatagatcttaccagcaggctcttgaaacttggttagataaccgaaatgatgcaagatcaagaagcattattcgtgagagatatattgctttagaacttgacattactactgctataccgcttttcagcatacgaaatcaagaggttccattattaatggtatatgctcaagctgcaaatttacacctattattattgagagacgcatccctttttggtagtgaatgggggatgtcatctgccgatgttaaccaatattaccaagaacaaatcagatatacagaggaatattctaaccattgcgtacaatggtataatacagggctaaatagattaagagggacaactgccgaaagttgggtacggtataatcaattccgtagagacctaacattaggtgtattagatttagtggcactattcccaagctatgacactcggacttatcccattccaactaccgcccaacttacaagagaagtgtatacagatccaaacggtgttgtagcaggacccaataatagttggtttagaaatggagcttcgttttccgctatagaaaacgcaattattcgacaacctcacctatatgattttctaacgaaccttacaatttacacgagaagaagtcaagtaggcactacaattatgaatttgtgggcagggcatagaatcacgtttaatagaatacaaggtggttctactagtgaaatggtgtatggggctattactaacccagttagtgttagtgacataccatttgtcaatcgggatgtttaccgaactgtatcattagctggtgggcttggctctctgagtggaatacgttatggtttaactagagttgattttgatatgatatttcgtaaccatcctgatatagtaactggattattttatcatccgggacacgcgggcattgcaacccaagtaaaagattcagaaacagaattaccacctgaaacgacagaacagccaaattatagagcatttagtcatctactaagtcatatttcaatgggtccaacgactcaagacgtacctccagtatattcttggacacaccagagtgcagatcgtacgaatacaatcaattcggataggataacacaaataccattggtaaaggcgcataccctccaatcgggtaccactgtagtaaaagggccagggtttacaggaggggatatcctccgtcgaacaagtggaggaccatttgcttttagtaatgttaatctagattttaacttgtcacaaaggtatcgtgctagaattcgttatgcctctactactaacctaagaatttacgtaacggttgcaggtgaacgaatttttgctggtcaatttgacaaaactatggatgctggtgccccattaacattccaatcttttagttacgcaactattaatacagcttttacattcccagaaagatcgagcagcttgactgtaggtgccgatacgtttagttcaggtaatgaagtttatgtagatagatttgaattaatcccagttactgcaaccttcgaggcagaatctgatttagaaagagcgcggaag

SEQ ID NO: 51 - DNA, 3771 bp, Bacillus thuringiensis
ttgacttcaaataggaaaaatgagaatgaaattataaatgctttatcgattccaacggtatcgaatccttccacgcaaatgaatctatcaccagatgctcgtattgaagatagcttgtgtgtagccgaggtgaacaatattgatccatttgttagcgcatcaacagtccaaacgggtataaacatagctggtagaatattgggcgtattaggtgtgccgtttgctggacaactagctagtttttatagttttcttgttggtgaattatggcctagtggcagagatccatgggaaattttcctggaacatgtagaacaacttataagacaacaagtaacagaaaatactaggaatacggctattgctcgattagaaggtctaggaagaggctatagatcttaccagcaggctcttgaaacttggttagataaccgaaatgatgcaagatcaagaagcattattcttgagcgctatgttgctttagaacttgacattactactgctataccgcttttcagaatacgaaatcaagaggttccattattaatggtatatgctcaagctgcaaatttacacctattattattgagggacgcatccctttttggtagtgaatgggggacggcatcttccgatgttaaccaatattaccaagaacaaatcagatatacagaggaatattctaaccattgcgtacaatggtataatacggggctaaataacttaagagggacaaatgctgaaagttgggtacggtataatcaattccgcagagacctaacattaggggtattagatctagtggccctattcccaagttatgacactcgcacttatccaatcaatacgagtgctcagttaacaagagaagtttatacagacgcaattgggaccgtacatccgagtcaagcttttgcaagtacgacttggtttaataataatgcaccatcgttttctgccatagaagctgccgttatcaggcctccgcatctacttgattttccagaacaacttacaatttacagcacattaagtcgatggagtaacactcagtttatgaatatatgggcaggtcatagacttgaatcccgcccaatagcagggtcattaaatacctctacacaaggatctaccaatacttctattaatcctgtaacattacagtttacgtctcgagacatttataggactgaatcattggcagggctaaatatatttataactcaacctgttaatggggttccttgggttagatttaattggagaaatcccctgaattctcttagaggtagccttctctatacgatagggtatactggagttgggacgcaattacaagattcagaaactgaattacccccagaaacaacagaacgaccaaattatgaatcatatagtcatagattatctcatataggactcatttcatcatctcatgtgagagcattggtatattcttggacgcaccgtagtgcagatcgtacgaatacgattggaccaaatagaattactcaaattcctgcagtgaagggaagatttctttttaatggctctgtaatttcaggaccaggatttactggtggagacgtagttagattgaataggaataatggtaatattcaaaatagagggtatattgaagttccaattcaattcacgtcgacatctaccagatatcgagttcgagtacgttatgcttctgtaacctcgattgagctcaatgttaattggggcaattcatcaatttttacgaacacattaccagcaacagctgcatcattagataatctacaatcaggggattttggttatgttgaaatcaacaatgcttttacatccgcaacaggtaatatagtaggtgttagaaattttagtgcaaatgcagaggtaataatagacagatttgaatttatcccagttactgcaaccttcgaggcaaaatatgatttagaaagagcacaaaaggcggtgaatgctctgtttacttctacaaatccaagaagattgaagacagatgtgacagattatcatattgaccaagtgtccaatctggtggtatgtttatcagatgaattttgcttggatgagaagcgagaattatttgagaaagtgaaatatgcgaagcgactcagtgatgaaagaaacttactccaagatccaaacttcacattcatcaatgggcaaccaagttttgcatccatcgatggacaatcaaacttcacctctattaatgagctatctaatcatggatggtggggcagtgcgaatgttaccattcaggaagggaatgacgtatttaaagagaattacgtcacactaccgggtacttttaatgagtgttatccaaattatttatatcaaaaaataggagagtcagaattaaaggcttatacgcgctatcaattaagagggtatattgaagatagtcaagatctagagatttatttaattcgttacaatgcaaagcatgaaacattaaatgttccaggtaccgagtccctatggccgctttcagttgaaagcccaatcggaaggtgcggagaaccaaatcgatgcgcaccacattttggatggaatcctgatctagattgttcctgcagagatagagaaaaatgtgcgcatcattcccatcatttcactttggatattgatgttggatgcacagacttgcaagaggatctaggcgtgtgggttgtattcaagattaagacgcaggaaggttatgcaagattaggaaatctggaatttatcgaagagaaaccattaattggagaagcactgtctcgtgtgaagagagcggaaaaaaaatggagagacaaaagggaaaaactacaagtggaaacaaaacgagtatatatagacgcaaaagaagctgtggatgctttattcgtagattctcaatatgatagattacaagcagatacaaacatcggtatgattcatgcggcagatagacttgttcatcggatccacgaggcttatcttccagaactacctttcattccaggaataaatgtggtgatttttgaagaattagaaaaccgtatttctactgcattttccttatatgatgcgagaaatgtcattaaaaatggcgatttcaataatggattgacatgctggaacgtgaaagggcatgtagaggtacagcagctgaacaatcatcgttcggtccttgtcatcccggaatgggaagcagaagtttcacaaaaggtgcgcgtctgtccaggtcgtggctatattcttcgtgtcacagcgtacaaagagggatatggggaaggctgcgtaactattcatgaagtcgataataatacagaccaattgaagtttagcaactgtgagaaaggacaagtatatccaggtaatacgatagcatgtaatgattataataagaatcatggtgcgaatgcatgtagttctcgtaatcgtggatatgacgaattctatggaaacaccccagctgattattctgcaaatcaaaaagaatacgggggtgcgtacacttcccacaatcatgcatatggcgaatcttatgaaagtaattcgtccataccagctgattatgcgccggtttatgaagaagaagcgtatacacatggacgaagaggtaattcttgtgaatataacagagggtatacaccattaccagctggttatgtgacagcagagttagaatacttcccagaaacggatacagtatgggttgagattggagaaacggaaggaacatttatcgtggacaatgtggaattactccttatggaggaatag

SEQ ID NO: 52 - protein, 1256 aa, Bacillus thuringiensis
MTSNRKNENEIINALSIPTVSNPSTQMNLSPDARIEDSLCVAEVNNIDPFVSASTVQTGINIAGRILGVLGVPFAGQLASFYSFLVGELWPSGRDPWEIFLEHVEQLIRQQVTENTRNTAIARLEGLGRGYRSYQQALETWLDNRNDARSRSIILERYVALELDITTAIPLFRIRNQEVPLLMVYAQAANLHLLLLRDASLFGSEWGTASSDVNQYYQEQIRYTEEYSNHCVQWYNTGLNNLRGTNAESWVRYNQFRRDLTLGVLDLVALFPSYDTRTYPINTSAQLTREVYTDAIGTVHPSQAFASTTWFNNNAPSFSAIEAAVIRPPHLLDFPEQLTIYSTLSRWSNTQFMNIWAGHRLESRPIAGSLNTSTQGSTNTSINPVTLQFTSRDIYRTESLAGLNIFITQPVNGVPWVRFNWRNPLNSLRGSLLYTIGYTGVGTQLQDSETELPPETTERPNYESYSHRLSHIGLISSSHVRALVYSWTHRSADRTNTIGPNRITQIPAVKGRFLFNGSVISGPGFTGGDVVRLNRNNGNIQNRGYIEVPIQFTSTSTRYRVRVRYASVTSIELNVNWGNSSIFTNTLPATAASLDNLQSGDFGYVEINNAFTSATGNIVGVRNFSANAEVIIDRFEFIPVTATFEAKYDLERAQKAVNALFTSTNPRRLKTDVTDYHIDQVSNLVVCLSDEFCLDEKRELFEKVKYAKRLSDERNLLQDPNFTFINGQPSFASIDGQSNFTSINELSNHGWWGSANVTIQEGNDVFKENYVTLPGTFNECYPNYLYQKIGESELKAYTRYQLRGYIEDSQDLEIYLIRYNAKHETLNVPGTESLWPLSVESPIGRCGEPNRCAPHFGWNPDLDCSCRDREKCAHHSHHFTLDIDVGCTDLQEDLGVWVVFKIKTQEGYARLGNLEFIEEKPLIGEALSRVKRAEKKWRDKREKLQVETKRVYIDAKEAVDALFVDSQYDRLQADTNIGMIHAADRLVHRIHEAYLPELPFIPGINVVIFEELENRISTAFSLYDARNVIKNGDFNNGLTCWNVKGHVEVQQLNNHRSVLVIPEWEAEVSQKVRVCPGRGYILRVTAYKEGYGEGCVTIHEVDNNTDQLKFSNCEKGQVYPGNTIACNDYNKNHGANACSSRNRGYDEFYGNTPADYSANQKEYGGAYTSHNHAYGESYESNSSIPADYAPVYEEEAYTHGRRGNSCEYNRGYTPLPAGYVTAELEYFPETDTVWVEIGETEGTFIVDNVELLLMEE

SEQ ID NO: 53 - DNA, 3714 bp, Bacillus thuringiensis
ttgaattcaaataggaaaaatgagaacgaaattatagatgcttcatttattcccgcagtatccaatgagtctgttacaatctctaaagaatatgcacaaacaaatcaattacaaaacaatagcattgaggatggtttgtgtatagccgaaggggaatatattgatccatttgttagcgcatcaacagtccaaacggggattagtatcgctggtagaatattgggtgtattaggtgtgccgtttgccggacaattagctagtttttatagttttattgttggtgaattatggcctaaaggcagagaccaatgggaaatttttatggaacatgtagaacaacttgtaagacaacaaataacagcaaatgctaggaatacggcccttgctcgattacaaggtttaggagattcctttagagcctatcaacagtcacttgaagattggctagagaaccgtaatgatgcaagaacgagaagtgttctttatactcaatatatagccttagagcttgattttctaaatgcgatgccgcttttcgcaataagagagcaagaggttcccttattaatggtatacgctcaagctgcaaacttgcacctattattattgagagacgcctccctttatggtcgtgaatttgggcttacctcccaagaaattcaacgttattatgaacgccaagtagaaagaacgagggactattctgaccattgcgtgcaatggtataatacgggtctaaataacttaagagggacaaatgctgaaagttgggtgcggtataatcaattccgtagagacctaacattaggggtattagatctagtggcactattcccaagctatgacactcgcacttatccaataaatacgagtgctcagttaacaagggaagtttatacagacgcaattggagcaacaggggtaaatatggcaagtatgaattggtataataataatgcaccttcgttttccgctatagagactgcggttatccgaagcccgcatctacttgattttctagaacaacttaaaatttttagcgcttcatcacgatggagtaatactaggcatatgacttattggcgggggcacacgattcaatctcggccaataagaggggcattaattacctcgacacacggaaataccaatacttctattaaccctgtaacattccagttcccgtcccgagacgtttataggactgaatcatatgcaggagtgcttctatggggaatttaccttgaacctattcatggtgttcctactgttagatttaattttaggaaccctcagaatacttttgaaagaggtactgctaactatagtcaaccctatgagtcacctgggcttcaattaaaagattcagaaactgaattaccaccagaaacaacagaacgaccaaattatgaatcatatagtcatagattatctcacatagggatcattttacaaactaggttgaatgtaccggtatattcttggacgcatcgtagtgcagatcgtacaaatacaattggaccaaatagaattactcaaattcctgcagtgaagggaaaccttctttttaatggttctgtaatttcaggaccaggatttactggtggggacttagttagattaaataatagtggaaataatattcaaaatagaggctatcttgaggttccaattcaattcacatcgacatctaccagatatcgagttcgtgtacgttatgcttctgtaaccccgattcacctcagtgttaattggggtaattcaaacattttttccagcacagttccagctacagctgcgtcattagataatctacaatcaagggattttggttattttgaaagtaccaatgcatttacatctgtaacaggtaatgtagtaggtgtaagaaattttagtgaaaatgccagagtgataatagacagatttgaatttattccagttactgcaaccttcgaagcagaatacgatttagaaagggcgcaagaggcggtgaatgctctgtttactaatacgaatccaagaagattgaaaacagatgtgacagattatcatattgatcaagtatccaatttagtggcgtgtttatcggatgaattctgcttagatgaaaagagagaattacttgagaaagtgaaatatgcgaaacgactcagtgatgaaagaaacttactccaagatccaaacttcacatccatcaataagcaaccagacttcatatctactaatgagcaatcgaatttcacatctatccatgaacaatctgaacatggatggtggggaagtgagaacattacaatccaggaaggaaatgacgtatttaaagagaattacgtcacactaccaggtacttataatgagtgttatccgacgtatttatatcaaaaaataggagagtcggaattaaaagcttatactcgctaccaattaagaggttatattgaagatagtcaagatttagagatatatttgattcgttataatgcgaaacatgaaacattggatgttccaggtaccgagtccgtatggccgctttcagttgaaagcccaatcagaaggtgcggagaaccgaatcgatgcgcaccacattttgaatggaatcctgatctagattgttcctgcagagatggagaaaaatgtgcgcatcattcccatcatttctctttggatattgatgttggatgcatagacttgcatgagaacctaggcgtgtgggtggtattcaagattaagacgcaggaaggtcatgcaagactagggaacctggaatttattgaagagaaaccattattaggagaagcactgtctcgtgtgaagagagcagagaaaaaatggagagacaaacgtgaaaaactacaattggaaacaaaacgagtatatacagaggcaaaagaagctgtggatgctttatttgtagattctcaatatgatagattacaagcggatacaaacattggcatgattcatgcggcagataaacttgttcatcgaattcgagaggcgtatctttcagaattatctgttatcccaggtgtaaatgcggaaatttttgaagaattagaaggtcgcattatcactgcaatctccctatacgatgcgagaaatgtcgttaaaaatggtgattttaataatggattagcatgctggaatgtaaaagggcatgtagatgtacaacagagccatcaccgttctgtccttgttatcccagaatgggaagcagaagtgtcacaagcagttcgcgtctgtccggggcgtggctatatcctccgtgtcacagcgtacaaagagggatatggagagggttgtgtaacgatccatgaaatcgagaacaatacagacgaactaaaatttaaaaactgtgaagaagaggaagtgtatccaacggatacaggaacgtgtaatgattatactgcacaccaaggtacagcagcatgtaattcccgtaatgctggatatgaggatgcatatgaagttgatactacagcatctgttaattacaaaccgacttatgaagaagaaacgtatacagatgtacgaagagataatcattgtgaatatgacagagggtatgtgaattatccaccagtaccagctggttatatgacaaaagaattagaatacttcccagaaaccgataaggtatggattgagattggagaaacggaagggaagtttattgtagacagcgtggaattactccttatggaggaatag

SEQ ID NO: 54 - protein, 1237 aa, Bacillus thuringiensis
MNSNRKNENEIIDASFIPAVSNESVTISKEYAQTNQLQNNSIEDGLCIAEGEYIDPFVSASTVQTGISIAGRILGVLGVPFAGQLASFYSFIVGELWPKGRDQWEIFMEHVEQLVRQQITANARNTALARLQGLGDSFRAYQQSLEDWLENRNDARTRSVLYTQYIALELDFLNAMPLFAIREQEVPLLMVYAQAANLHLLLLRDASLYGREFGLTSQEIQRYYERQVERTRDYSDHCVQWYNTGLNNLRGTNAESWVRYNQFRRDLTLGVLDLVALFPSYDTRTYPINTSAQLTREVYTDAIGATGVNMASMNWYNNNAPSFSAIETAVIRSPHLLDFLEQLKIFSASSRWSNTRHMTYWRGHTIQSRPIRGALITSTHGNTNTSINPVTFQFPSRDVYRTESYAGVLLWGIYLEPIHGVPTVRFNFRNPQNTFERGTANYSQPYESPGLQLKDSETELPPETTERPNYESYSHRLSHIGIILQTRLNVPVYSWTHRSADRTNTIGPNRITQIPAVKGNLLFNGSVISGPGFTGGDLVRLNNSGNNIQNRGYLEVPIQFTSTSTRYRVRVRYASVTPIHLSVNWGNSNIFSSTVPATAASLDNLQSRDFGYFESTNAFTSVTGNVVGVRNFSENARVIIDRFEFIPVTATFEAEYDLERAQEAVNALFTNTNPRRLKTDVTDYHIDQVSNLVACLSDEFCLDEKRELLEKVKYAKRLSDERNLLQDPNFTSINKQPDFISTNEQSNFTSIHEQSEHGWWGSENITIQEGNDVFKENYVTLPGTYNECYPTYLYQKIGESELKAYTRYQLRGYIEDSQDLEIYLIRYNAKHETLDVPGTESVWPLSVESPIRRCGEPNRCAPHFEWNPDLDCSCRDGEKCAHHSHHFSLDIDVGCIDLHENLGVWVVFKIKTQEGHARLGNLEFIEEKPLLGEALSRVKRAEKKWRDKREKLQLETKRVYTEAKEAVDALFVDSQYDRLQADTNIGMIHAADKLVHRIREAYLSELSVIPGVNAEIFEELEGRIITAISLYDARNVVKNGDFNNGLACWNVKGHVDVQQSHHRSVLVIPEWEAEVSQAVRVCPGRGYILRVTAYKEGYGEGCVTIHEIENNTDELKFKNCEEEEVYPTDTGTCNDYTAHQGTAACNSRNAGYEDAYEVDTTASVNYKPTYEEETYTDVRRDNHCEYDRGYVNYPPVPAGYMTKELEYFPETDKVWIEIGETEGKFIVDSVELLLMEE

SEQ ID NO: 55 - protein, 650 aa, Bacillus thuringiensis
MTSNRKNENEIINAVSNHSAQMDLLPDARIEDSLCIAEGNNIDPFVSASTVQTGINIAGRILGVLGVPFAGQLASFYSFLVGELWPRGRDQWEIFLEHVEQLINQQITENARNTALARLQGLGDSFRAYQQSLEDWLENRDDARTRSVLYTQYIALELDFLNAMPLFAIRNQEVPLLMVYAQAANLHLLLLRDASLFGSEFGLTSQEIQRYYERQVERTRDYSDYCVEWYNTGLNSLRGTNAASWVRYNQFRRDLTLGVLDLVALFPSYDTRTYPINTSAQLTREVYTDAIGATGVNMASMNWYNNNAPSFSAIEAAAIRSPHLLDFLEQLTIFSASSRWSNTRHMTYWRGHTIQSRPIGGGLNTSTHGATNTSINPVTLRFASRDVYRTESYAGVLLWGIYLEPIHGVPTVRFNFTNPQNISDRGTANYSQPYESPGLQLKDSETELPPETTERPNYESYSHRLSHIGIILQSRVNVPVYSWTHRSADRTNTIGPNRITQIPMVKASELPQGTTVVRGPGFTGGDILRRTNTGGFGPIRVTVNGPLTQRYRIGFRYASTVDFDFFVSRGGTTVNNFRFLRTMNSGDELKYGNFVRRAFTTPFTFTQIQDIIRTSIQGLSGNGEVYIDKIEIIPVTATFEAEYDLERAQE

SEQ ID NO: 56 - protein, 655 aa, Bacillus thuringiensis
MTSNRKNENEIINALSIPTVSNPSTQMNLSPDARIEDSLCVAEVNNIDPFVSASTVQTGINIAGRILGVLGVPFAGQLASFYSFLVGELWPSGRDPWEIFLEHVEQLIRQQVTENTRNTAIARLEGLGRGYRSYQQALETWLDNRNDARSRSIILERYVALELDITTAIPLFRIRNEEVPLLMVYAQAANLHLLLLRDASLFGSEWGMASSDVNQYYQEQIRYTEEYSNHCVQWYNTGLNNLRGTNAESWLRYNQFRRDLTLGVLDLVALFPSYDTRTYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTQGLTNNTSINPVTLQFTSRDVYRTESNAGTNILFTTPVNGVPWARFNFINPQNIYERGATTYSQPYQGVGIQLFDSETELPPETTERPNYESYSHRLSHIGLIIGNTLRAPVYSWTHRSADRTNTIGPNRITQIPLVKALNLHSGVTVVGGPGFTGGDILRRTNTGTFGDIRLNINVPLSQRYRVRIRYASTTDLQFFTRINGTTVNIGNFSRTMNRGDNLEYRSFRTAGFSTPFNFLNAQSTFTLGAQSFSNQEVYIDRVEFVPAEVTFEAEYDLERAQK

SEQ ID NO: 57 - protein, 655 aa, Bacillus thuringiensis; identical to SEQ ID NO: 56

SEQ ID NO: 58 - protein, 653 aa, Bacillus thuringiensis
MTSNRKNENEIINALSIPAVSNHSAQMNLSTDARIEDSLCIAEGNNIDPFVSASTVQTGINIAGRILGVLGVPFAGQIASFYSFLVGELWPRGRDPWEIFLEHVEQLIRQQVTENTRDTALARLQGLGNSFRAYQQSLEDWLENRDDARTRSVLYTQYIALELDFLNAMPLFAIRNQEVPLLMVYAQAANLHLLLLRDASLFGSEFGLTSQEIQRYYERQVEKTREYSDYCARWYNTGLNNLRGTNAESWLRYNQFRRDLTLGVLDLVALFPSYDTRVYPMNTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESFAGINILLTTPVNGVPWARFNWRNPLNSLRGSLLYTIGYTGVGTQLFDSETELPPETTERPNYESYSHRLSNIRLISGNTLRAPVYSWTHRSADRTNTISSDSITQIPLVKSFNLNSGTSVVSGPGFTGGDIIRTNVNGSVLSMGLNFNNTSLQRYRVRVRYAASQTMVLRVTVGGSTTFDQGFPSTMSANESLTSQSFRFAEFPVGISASGSQTAGISISNNAGRQTFHFDKIEFIPITATFEAEYDLERAQE

SEQ ID NO: 59 - protein, 654 aa, Bacillus thuringiensis
MTSNRKNENEIINALSIPAVSNHSTQMDLSPDARIEDSLCIAEGNNINPLVSASTVQTGINIAGRILGVLGVPFAGQIASFYSFLVGELWPRGRDQWEIFLEHVEQLINQQITENARNTALARLQGLGDSFRAYQQSLEDWLENRDDARTRSVLYTQYIALELDFLNAMPLFAIRNQEVPLLMVYAQAANLHLLLLRDASLFGSEFGLTSQEIQRYYERQVEQTRDYSDYCVEWYNTGLNSLRGTNAASWVRYNQFRRDLTLGVLDLVALFPSYDTRTYPINTSAQLTREVYTDAIGATGVNMASMNWYNNNAPSFSAIETAVIRSPHLLDFLEQLTIFSTSSRWSATRHMTYWRGHTIQSRPIGGGLNTSTHGSTNTSINPVRLSFFSRDVYWTESYAGVLLWGIYLEPIHGVPTVRFNFRNPQNTFERGTANYSQPYESPGLQLKDSETELPPETTERPNYESYSHRLSHIGLISQSRVHVPVYSWTHRSADRTNTISSDSITQIPLVKSFNLNSGTSVVSGPGFTGGDIIRTNVNGSVLSMGLNFNNTSLQRYRVRVRYAASQTMVLRVTVGGSTTFDQGFPSTMSANESLTSQSFRFAEFPVGISASGSQTAGISISNNAGRQTFHFDKIEFIPITATFEAEYDLERAQE

SEQ ID NO: 60 - protein, 661 aa, Bacillus thuringiensis
MNSNRKNENEIIDASFIPAVSNESVTISKEYAQTNQLQNNSIEDGLCIAEGEYIDPFVSASTVQTGISIAGRILGVLGVPFAGQLASFYSFIVGELWPKGRDQWEIFMEHVEQLVRQQITANARNTALARLQGLGDSFRAYQQSLEDWLENRNDARTRSVLYTQYIALELDFLNAMPLFAIREQEVPLLMVYAQAANLHLLLLRDASLYGREFGLTSQEIQRYYERQVERTRDYSDHCVQWYNTGLNNLRGTNAESWVRYNQFRRDLTLGVLDLVALFPSYDTRTYPINTSAQLTREVYTDAIGATGVNMASMNWYNNNAPSFSAIETAVIRSPHLLDFLEQLKIFSASSRWSNTRHMTYWRGHTIQSRPIRGALITSTHGNTNTSINPVTFQFPSRDVYRTESYAGVLLWGIYLEPIHGVPTVRFNFRNPQNTFERGTANYSQPYESPGLQLKDSETELPPETTERPNYESYSHRLSHIGIILQTRLNVPVYSWTHRSADRTNTISSDSITQIPLVKSFNLNSGTSVVSGPGFTGGDIIRTNVNGSVLSMGLNFNNTSLQRYRVRVRYAASQTMVLRVTVGGSTTFDQGFPSTMSANESLTSQSFRFAEFPVGISASGSQTAGISISNNAGRQTFHFDKIEFIPITATFEAEYDLERAQE

SEQ ID NO: 61 - protein, 643 aa, Bacillus thuringiensis
MKNSIKLSELWYFNERKWRYFMEIVNNQNQCVPYNCLNNPEIEILEGGRISVGNTPIDISLSLTQFLLSEFVPGAGFVLGLIDLIWGFVGPSQWDAFLAQVEQLINQRIAEAVRNTAIQELEGMARVYRTYATAFAEWEKAPDDPELREALRTQFTATETYISGRISVLKIQTFEVQLLSVFAQAANLHLSLLRDVVFFGQRWGFSTTTVNNYYNDLTEGISTYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQK

SEQ ID NO: 62 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLYFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 63 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFRSTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 64 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFLAEYDLERAQE

SEQ ID NO: 65 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFTAEYDLERAQE

SEQ ID NO: 66 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEHEYDLERAQE

SEQ ID NO: 67 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLYFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLSNLQSRNFGYFHSRNAFTSATGNVVGVRNFSENAGVIIDRFEFIPVTATFEAEYDLERAQE

SEQ ID NO: 68 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLYFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLSNLQSRNFGYFQSRNAFTSATGNVVGVRNFSENAGVIIDRFEFIPVTATFEAEYDLERAQE

SEQ ID NO: 69 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLYFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLSTLQSRNFGYFHSRNAFTSATGNVVGVRNFSENAGVIIDRFEFIPVTATFEAEYDLERAQE

SEQ ID NO: 70 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLYFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLSVLQSRNFGYFESRNAFTSATGNVVGVRNFSENAGVIIDRFEFIPVTATFEAEYDLERAQE

SEQ ID NO: 71 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLYFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLSVLQSRNFGYFQSRNAFTSATGNVVGVRNFSENAGVIIDRFEFIPVTATFEAEYDLERAQE

SEQ ID NO: 72 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLYFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDTLQSRNFGYFQSRNAFTSATGNVVGVRNFSENAGVIIDRFEFIPVTATFEAEYDLERAQE

SEQ ID NO: 73 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLYFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDVLQSRNFGYFHSRNAFTSATGNVVGVRNFSENAGVIIDRFEFIPVTATFEAEYDLERAQE

SEQ ID NO: 74 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFRSTSTRYRVRVRYASVTPIRLSVNWGNSNIFSSIVPATATSLDTLQSRNFGYFHSRNAFTSATGNVVGVRNFSENAGVIIDRFEFIPVTATFEAEYDLERAQE

SEQ ID NO: 75 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFRSTSTRYRVRVRYASVTPIRLSVNWGNSNIFSSIVPATATSLDVLQSRNFGYFHSRNAFTSATGNVVGVRNFSENAGVIIDRFEFIPVTATFEAEYDLERAQE

SEQ ID NO: 76 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHLTYNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEHEYDLERAQE

SEQ ID NO: 77 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITYNARNTALARLQGLGASFRAYQQSLEDWLENRDNARTRSVLYTQYIALELDFLNAMPLFAINNQQVPLLMVYAQAANLHLLLLRDASLFGSEFGLTRQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEHEYDLERAQE

SEQ ID NO: 78 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITYNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGHNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEHEYDLERAQE

SEQ ID NO: 79 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 80 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVIGGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 81 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNESGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 82 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFPSTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 83 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFQSTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 84 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASATPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 85 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASGTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 86 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTALFEAEYDLERAQE

SEQ ID NO: 87 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLSTLQSRNFGYFESRNAFTSATGNVVGVRNFSENAGVIIDRFEFIPVTATFEAEYDLERAQE

SEQ ID NO: 88 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLYFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLSTLQSRNFGYFQSRNAFTSATGNVVGVRNFSENAGVIIDRFEFIPVTATFEAEYDLERAQE

SEQ ID NO: 89 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLYFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLSVLQSRNFGYFHSRNAFTSATGNVVGVRNFSENAGVIIDRFEFIPVTATFEAEYDLERAQE

SEQ ID NO: 90 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLYFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDTLQSRNFGYFHSRNAFTSATGNVVGVRNFSENAGVIIDRFEFIPVTATFEAEYDLERAQE

SEQ ID NO: 91 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLYFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDVLQSRNFGYFQSRNAFTSATGNVVGVRNFSENAGVIIDRFEFIPVTATFEAEYDLERAQE

SEQ ID NO: 92 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFRSTSTRYRVRVRYASVTPIRLSVNWGNSNIFSSIVPATATSLSNLQSRNFGYFHSRNAFTSATGNVVGVRNFSENAGVIIDRFEFIPVTATFEAEYDLERAQE

SEQ ID NO: 93 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFRSTSTRYRVRVRYASVTPIRLSVNWGNSNIFSSIVPATATSLDVLQSRNFGYFQSRNAFTSATGNVVGVRNFSENAGVIIDRFEFIPVTATFEAEYDLERAQE

SEQ ID NO: 94 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFRSTSTRYRVRVRYASVTPIRLSVNWGNSNIFSSIVPATATSLSNLQSRNFGYFQSRNAFTSATGNVVGVRNFSENAGVIIDRFEFIPVTATFEAEYDLERAQE

SEQ ID NO: 95 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFRSTSTRYRVRVRYASVTPIRLSVNWGNSNIFSSIVPATATSLSTLQSRNFGYFESRNAFTSATGNVVGVRNFSENAGVIIDRFEFIPVTATFEAEYDLERAQE

SEQ ID NO: 96 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFRSTSTRYRVRVRYASVTPIRLSVNWGNSNIFSSIVPATATSLSTLQSRNFGYFHSRNAFTSATGNVVGVRNFSENAGVIIDRFEFIPVTATFEAEYDLERAQE

SEQ ID NO: 97 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFRSTSTRYRVRVRYASVTPIRLSVNWGNSNIFSSIVPATATSLSVLQSRNFGYFESRNAFTSATGNVVGVRNFSENAGVIIDRFEFIPVTATFEAEYDLERAQE

SEQ ID NO: 98 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPEAGQLASFYSFIVGELWPSGRDPWEIFMEHVEQLVRQSITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 99 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQSLTMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 100 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQSITYNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 101 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQSITMNARNTALARLQGLGASFRAYQQSLEDWLENRDNAATRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 102 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQSITMNARNTALARLQGLGASFRAYQQSLEDWLENRDNARTRSVLYTQYIALELDFLNAMPLFAINNQQVPLLMVYAQAANLHLLLLRDASLFGSEFGLTRQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 103 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQSITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLMGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 104 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQSITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLVGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 105 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQSITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGQNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 106 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQSITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGHNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 107 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQSITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGKNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 108 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPEAGQLASFYSFIVGELWPSGRDPWEIFMEHVEQLVRQHITYNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 109 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHLTYNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 110 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITYNARNTALARLQGLGASFRAYQQSLEDWLENRDNAATRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 111 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITYNARNTALARLQGLGASFRAYQQSLEDWLENRDNARTRSVLYTQYIALELDFLNAMPLFAINNQQVPLLMVYAQAANLHLLLLRDASLFGSEFGLTRQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 112 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITYNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLMGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 113 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITYNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLVGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 114 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITYNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGQNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 115 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITYNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGHNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 116 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITYNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGKNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEAEYDLERAQE

SEQ ID NO: 117 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITYNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLYFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDVLQSRNFGYFHSRNAFTSATGNVVGVRNFSENAGVIIDRFEFIPVTATFEAEYDLERAQE

SEQ ID NO: 118 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHLTYNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLYFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDVLQSRNFGYFHSRNAFTSATGNVVGVRNFSENAGVIIDRFEFIPVTATFEAEYDLERAQE

SEQ ID NO: 119 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITYNARNTALARLQGLGASFRAYQQSLEDWLENRDNARTRSVLYTQYIALELDFLNAMPLFAINNQQVPLLMVYAQAANLHLLLLRDASLFGSEFGLTRQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLYFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDVLQSRNFGYFHSRNAFTSATGNVVGVRNFSENAGVIIDRFEFIPVTATFEAEYDLERAQE

SEQ ID NO: 120 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITYNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGHNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLYFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDVLQSRNFGYFHSRNAFTSATGNVVGVRNFSENAGVIIDRFEFIPVTATFEAEYDLERAQE

SEQ ID NO: 121 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITYNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGKNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLYFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDVLQSRNFGYFHSRNAFTSATGNVVGVRNFSENAGVIIDRFEFIPVTATFEAEYDLERAQE

SEQ ID NO: 122 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGKNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLYFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDVLQSRNFGYFHSRNAFTSATGNVVGVRNFSENAGVIIDRFEFIPVTATFEAEYDLERAQE

SEQ ID NO: 123 - protein, 655 aa, Artificial Sequence
  Cry1B variant
MPSNRKNENEIINALSIPAVSNHSAQMDLSLDARIEDSLCIAEGNNINPLVSASTVNTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEHEYDLERAQE

SEQ ID NO: 124 - protein, 655 aa, Artificial Sequence
  Cry1B variant
MPSNRKNENEIINALSIPAVSNHSAQMDLSLDARIEDSLCIAEGNNINPLVSASTVQTGINIAGRIMGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEHEYDLERAQE

SEQ ID NO: 125 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGNLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEHEYDLERAQE

SEQ ID NO: 126 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLISFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEHEYDLERAQE

SEQ ID NO: 127 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLAQFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEHEYDLERAQE

SEQ ID NO: 128 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYAFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEHEYDLERAQE

SEQ ID NO: 129 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYRFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEHEYDLERAQE

SEQ ID NO: 130 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEHLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEHEYDLERAQE

SEQ ID NO: 131 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRTNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEHEYDLERAQE

SEQ ID NO: 132 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSREIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEHEYDLERAQE

SEQ ID NO: 133 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQVEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEHEYDLERAQE

SEQ ID NO: 134 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTVEYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEHEYDLERAQE

SEQ ID NO: 135 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTRDYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEHEYDLERAQE

SEQ ID NO: 136 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCAKWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEHEYDLERAQE

SEQ ID NO: 137 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARRYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEHEYDLERAQE

SEQ ID NO: 138 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNASSWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEHEYDLERAQE

SEQ ID NO: 139 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITYNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEHEYDLERAQE

SEQ ID NO: 140 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITYNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGQNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEHEYDLERAQE

SEQ ID NO: 141 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITYNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGKNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEHEYDLERAQE

SEQ ID NO: 142 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHITMNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGKNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEHEYDLERAQE

SEQ ID NO: 143 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHLTYNARNTALARLQGLGASFRAYQQSLEDWLENRDNARTRSVLYTQYIALELDFLNAMPLFAINNQQVPLLMVYAQAANLHLLLLRDASLFGSEFGLTSQEIQRYYERQAEKTREYSDYCARWYNTGLNNLRGHNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEHEYDLERAQE

SEQ ID NO: 144 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFIVGELWPSGRDPWEIFMEHVEQLVRQHLTYNARNTALARLQGLGASFRAYQQSLEDWLENRDNARTRSVLYTQYIALELDFLNAMPLFAINNQQVPLLMVYAQAANLHLLLLRDASLFGSEFGLTRQEIQRYYERQAEKTREYSDYCARWYNTGLNNLRGHNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTHGATNTSINPVTLQFTSRDVYRTESYAGINILLTTPVNGVPWARFNWRNPLNSLRGSLLYTIGYTGVGTQLFDSETELPPETTERPNYESYSHRLSNIRLIIGGTLRAPVYSWTHRSADRTNTIATNIITQIPAVKGNFLFNGLVISGPGFTGGDLVRLNNSGNNIQNRGYIEVPIQFISTSTRYRVRVRYASVTPIRLSVNWGNSNIFSSIVPATATSLDNLQSRNFGYFESRNAFTSATGNVVGVRNFSENAGVIIDRFEFIPVTATFEHEYDLERAQE

SEQ ID NO: 145 - protein, 655 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFLVGELWPSGRDPWEIFLEHVEQLIRQQVTENTRNTAIARLEGLGRGYRSYQQALETWLDNRNDARSRSIILERYVALELDITTAIPLFRIRNEEVPLLMVYAQAANLHLLLLRDASLFGSEWGMASSDVNQYYQEQIRYTEEYSNHCVQWYNTGLNNLRGTNAESWLRYNQFRRDLTLGVLDLVALFPSYDTRTYPINTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESYAGINILLTTPVNGVPWARFNWRNPLNSLRGSLLYTIGYTGVGTQLFDSETELPPETTERPNYESYSHRLSNIRLISGNTLRAPVYSWTHRSADRTNTIATNIITQIPAVKGNFLFNGSVISGPGFTGGDLVRLNNSGNNIQNRGYLEVPIQFISTSTRYRVRVRYASVTPIQLSVNWGNSNIFSSIVPATATSLDNLQSRDFGYFESTNAFTSATGNVVGVRNFSENAGVIIDRFEFIPVTATFEAEYDLERAQE

SEQ ID NO: 146 - protein, 657 aa, Artificial Sequence
  Cry1B variant
MTSNRKNENEIINALSIPAVSNHSAQMDLSPDARIEDSLCIAEGNNINPLVSASTVQTGINIAGRILGVLGVPFAGQLASFYSFIVGELWPSGRDPWEIFLEHVEQLVRQQITENARNTALARLQGLGASFRAYQQSLEDWLENRDDARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTQGLTNNTSINPVTLQFTSRDVYRTESNAGTNILFTTPVNGVPWARFNFINPQNIYERGATTYSQPYQGVGIQLFDSETELPPETTERPNYESYSHRLSHIGLIIGNTLRAPVYSWTHRSADRTNTIATNIITQIPAVKGNFLFNGSVISGPGFTGGDLVRLNNSGNNIQNRGYLEVPIQFISTSTRYRVRVRYASVTPIQLSVNWGNSNIFSSIVPATATSLDNLQSRDFGYFESTNAFTSATGNVVGVRNFSENAGVIIDRFEFIPVTATFEAEYDLERAQE

SEQ ID NO: 147 - protein, 655 aa, Artificial Sequence
  Cry1B variant
MTSNRKNENEIINALSIPAVSNHSAQMDLSPDARIEDSLCIAEGNNINPLVSASTVQTGINIAGRILGVLGVPFAGQLASFYSFIVGELWPSGRDPWEIFLEHVEQLIRQQVTENTRNTAIARLEGLGRGYRSYQQALETWLDNRNDARSRSIILERYVALELDITTAIPLFRIRNEEVPLLMVYAQAANLHLLLLRDASLFGSEWGMASSDVNQYYQEQIRYTEEYSNHCVQWYNTGLNNLRGTNAESWLRYNQFRRDLTLGVLDLVALFPSYDTRIYPINTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESYAGINILLTTPVNGVPWARFNWRNPLNSLRGSLLYTIGYTGVGTQLFDSETELPPETTERPNYESYSHRLSNIRLISGNTLRAPVYSWTHRSADRTNTIATNIITQIPAVKGNFLFNGSVISGPGFTGGDLVRLNNSGNNIQNRGYLEVPIQFISTSTRYRVRVRYASVTPIQLSVNWGNSNIFSSIVPATATSLDNLQSRDFGYFESTNAFTSATGNVVGVRNFSENAGVIIDRFEFIPVTATFEAEYDLERAQE

SEQ ID NO: 148 - protein, 657 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFLVGELWPSGRDPWEIFLEHVEQLVRQQITENARNTALARLQGLGASFRAYQQSLEDWLENRDDARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRTYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTQGLTNNTSINPVTLQFTSRDVYRTESNAGTNILFTTPVNGVPWARFNFINPQNIYERGATTYSQPYQGVGIQLFDSETELPPETTERPNYESYSHRLSHIGLIIGNTLRAPVYSWTHRSADRTNTIGPNRITQIPAVKGRFLFNGSVISGPGFTGGDVVRLNRNNGNIQNRGYIEVPIQFTSTSTRYRVRVRYASVTSIELNVNLGNSSIFTNTLPATAASLDNLQSGDFGYVEINNAFTSATGNIVGARNFSANAEVIIDRFEFIPVTATFEAEYDLERAQK

SEQ ID NO: 149 - protein, 654 aa, Artificial Sequence
  Cry1B variant
TSNRKNENEIINALSIPAVSNHSAQMDLSPDARIEDSLCIAEGNNINPLVSASTVQTGINIAGRILGVLGVPFAGQLASFYSFIVGELWPSGRDPWEIFLEHVEQLVRQQVTENTRNTAIARLEGLGRGYRSYQQALETWLDNRDDARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESYAGINILLTTPVNGVPWARFNWRNPLNSLRGSLLYTIGYTGVGTQLFDSETELPPETTERPNYESYSHRLSNIRLISGNTLRAPVYSWTHRSADRTNTIATNIITQIPAVKGNFLFNGSVISGPGFTGGDLVRLNNSGNNIQNRGYLEVPIQFISTSTRYRVRVRYASVTPIQLSVNWGNSNIFSSIVPATATSLDNLQSRDFGYFESTNAFTSATGNVVGVRNFSENAGVIIDRFEFIPVTATFEAEYDLERAQE

SEQ ID NO: 150 - protein, 655 aa, Artificial Sequence
  Cry1B variant
MTSNRKNENEIINALSIPAVSNHSAQMDLSPDARIEDSLCIAEGNNINPLVSASTVQTGINIAGRILGVLGVPFAGQLASFYSFIVGELWPSGRDPWEIFLEHVEQLVRQQITENARNTALARLQGLGASFRAYQQSLEDWLENRNDARSRSIILERYVALELDITTAIPLFRIRNEEVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESYAGINILLTTPVNGVPWARFNWRNPLNSLRGSLLYTIGYTGVGTQLFDSETELPPETTERPNYESYSHRLSNIRLISGNTLRAPVYSWTHRSADRTNTIATNIITQIPAVKGNFLFNGSVISGPGFTGGDLVRLNNSGNNIQNRGYLEVPIQFISTSTRYRVRVRYASVTPIQLSVNWGNSNIFSSIVPATATSLDNLQSRDFGYFESTNAFTSATGNVVGVRNFSENAGVIIDRFEFIPVTATFEAEYDLERAQE

SEQ ID NO: 151 - protein, 655 aa, Artificial Sequence
  Cry1B variant
MTSNRKNENEIINALSIPAVSNHSAQMDLSPDARIEDSLCIAEGNNINPLVSASTVQTGINIAGRILGVLGVPFAGQLASFYSFIVGELWPSGRDPWEIFLEHVEQLVRQQITENARNTALARLQGLGASFRAYQQSLEDWLENRDDARTRSVLYTQYIALELDFLNAMPLFAINNQQVPLLMVYAQAANLHLLLLRDASLFGSEWGMASSDVNQYYQEQIRYTEEYSNHCVQWYNTGLNNLRGTNAESWLRYNQFRRDLTLGVLDLVALFPSYDTRIYPINTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESYAGINILLTTPVNGVPWARFNWRNPLNSLRGSLLYTIGYTGVGTQLFDSETELPPETTERPNYESYSHRLSNIRLISGNTLRAPVYSWTHRSADRTNTIATNIITQIPAVKGNFLFNGSVISGPGFTGGDLVRLNNSGNNIQNRGYLEVPIQFISTSTRYRVRVRYASVTPIQLSVNWGNSNIFSSIVPATATSLDNLQSRDFGYFESTNAFTSATGNVVGVRNFSENAGVIIDRFEFIPVTATFEAEYDLERAQE

SEQ ID NO: 152 - protein, 655 aa, Artificial Sequence
  Cry1B variant
MTSNRKNENEIINALSIPAVSNHSAQMDLSPDARIEDSLCIAEGNNINPLVSASTVQTGINIAGRILGVLGVPFAGQLASFYSFIVGELWPSGRDPWEIFLEHVEQLVRQQVTENTRNTAIARLEGLGRGYRSYQQALETWLDNRNDARSRSIILERYVALELDITTAIPLFRIRNEEVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRIYPINTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESYAGINILLTTPVNGVPWARFNWRNPLNSLRGSLLYTIGYTGVGTQLFDSETELPPETTERPNYESYSHRLSNIRLISGNTLRAPVYSWTHRSADRTNTIATNIITQIPAVKGNFLFNGSVISGPGFTGGDLVRLNNSGNNIQNRGYLEVPIQFISTSTRYRVRVRYASVTPIQLSVNWGNSNIFSSIVPATATSLDNLQSRDFGYFESTNAFTSATGNVVGVRNFSENAGVIIDRFEFIPVTATFEAEYDLERAQE

SEQ ID NO: 153 - protein, 655 aa, Artificial Sequence
  Cry1B variant
MTSNRKNENEIINALSIPAVSNHSAQMDLSPDARIEDSLCIAEGNNINPLVSASTVQTGINIAGRILGVLGVPFAGQLASFYSFIVGELWPSGRDPWEIFLEHVEQLVRQQITENARNTALARLQGLGASFRAYQQSLEDWLENRNDARSRSIILERYVALELDITTAIPLFRIRNEEVPLLMVYAQAANLHLLLLRDASLFGSEWGMASSDVNQYYQEQIRYTEEYSNHCVQWYNTGLNNLRGTNAESWLRYNQFRRDLTLGVLDLVALFPSYDTRIYPINTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESYAGINILLTTPVNGVPWARFNWRNPLNSLRGSLLYTIGYTGVGTQLFDSETELPPETTERPNYESYSHRLSNIRLISGNTLRAPVYSWTHRSADRTNTIATNIITQIPAVKGNFLFNGSVISGPGFTGGDLVRLNNSGNNIQNRGYLEVPIQFISTSTRYRVRVRYASVTPIQLSVNWGNSNIFSSIVPATATSLDNLQSRDFGYFESTNAFTSATGNVVGVRNFSENAGVIIDRFEFIPVTATFEAEYDLERAQE

SEQ ID NO: 154 - protein, 655 aa, Artificial Sequence
  Cry1B variant
MTSNRKNENEIINALSIPAVSNHSAQMDLSPDARIEDSLCIAEGNNINPLVSASTVQTGINIAGRILGVLGVPFAGQLASFYSFIVGELWPSGRDPWEIFLEHVEQLVRQQVTENTRNTAIARLEGLGRGYRSYQQALETWLDNRDDARTRSVLYTQYIALELDFLNAMPLFAINNQQVPLLMVYAQAANLHLLLLRDASLFGSEWGMASSDVNQYYQEQIRYTEEYSNHCVQWYNTGLNNLRGTNAESWLRYNQFRRDLTLGVLDLVALFPSYDTRIYPINTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESYAGINILLTTPVNGVPWARFNWRNPLNSLRGSLLYTIGYTGVGTQLFDSETELPPETTERPNYESYSHRLSNIRLISGNTLRAPVYSWTHRSADRTNTIATNIITQIPAVKGNFLFNGSVISGPGFTGGDLVRLNNSGNNIQNRGYLEVPIQFISTSTRYRVRVRYASVTPIQLSVNWGNSNIFSSIVPATATSLDNLQSRDFGYFESTNAFTSATGNVVGVRNFSENAGVIIDRFEFIPVTATFEAEYDLERAQE

SEQ ID NO: 155 - protein, 657 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFLVGELWPSGRDPWEIFLEHVEQLVRQQITENARNTALARLQGLGASFRAYQQSLEDWLENRDDARSRSIILERYVALELDITTAIPLFRIRNEEVPLLMVYAQAANLHLLLLRDASLFGSEWGMASSDVNQYYQEQIRYTEEYSNHCVQWYNTGLNNLRGTNAESWLRYNQFRRDLTLGVLDLVALFPSYDTRTYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTQGLTNNTSINPVTLQFTSRDVYRTESNAGTNILFTTPVNGVPWARFNFINPQNIYERGATTYSQPYQGVGIQLFDSETELPPETTERPNYESYSHRLSHIGLIIGNTLRAPVYSWTHRSADRTNTIGPNRITQIPAVKGRFLFNGSVISGPGFTGGDVVRLNRNNGNIQNRGYIEVPIQFTSTSTRYRVRVRYASVTSIELNVNLGNSSIFTNTLPATAASLDNLQSGDFGYVEINNAFTSATGNIVGARNFSANAEVIIDRFEFIPVTATFEAEYDLERAQK

SEQ ID NO: 156 - protein, 657 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFLVGELWPSGRDPWEIFLEHVEQLIRQQVTENTRNTAIARLEGLGRGYRSYQQALETWLDNRNDARTRSVLYTQYIALELDFLNAMPLFAINNQQVPLLMVYAQAANLHLLLLRDASLFGSEWGMASSDVNQYYQEQIRYTEEYSNHCVQWYNTGLNNLRGTNAESWLRYNQFRRDLTLGVLDLVALFPSYDTRTYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTQGLTNNTSINPVTLQFTSRDVYRTESNAGTNILFTTPVNGVPWARFNFINPQNIYERGATTYSQPYQGVGIQLFDSETELPPETTERPNYESYSHRLSHIGLIIGNTLRAPVYSWTHRSADRTNTIGPNRITQIPAVKGRFLFNGSVISGPGFTGGDVVRLNRNNGNIQNRGYIEVPIQFTSTSTRYRVRVRYASVTSIELNVNLGNSSIFTNTLPATAASLDNLQSGDFGYVEINNAFTSATGNIVGARNFSANAEVIIDRFEFIPVTATFEAEYDLERAQK

SEQ ID NO: 157 - protein, 657 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFLVGELWPSGRDPWEIFLEHVEQLIRQQVTENTRNTAIARLEGLGRGYRSYQQALETWLDNRNDARSRSIILERYVALELDITTAIPLFRIRNEEVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRTYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTQGLTNNTSINPVTLQFTSRDVYRTESNAGTNILFTTPVNGVPWARFNFINPQNIYERGATTYSQPYQGVGIQLFDSETELPPETTERPNYESYSHRLSHIGLIIGNTLRAPVYSWTHRSADRTNTIGPNRITQIPAVKGRFLFNGSVISGPGFTGGDVVRLNRNNGNIQNRGYIEVPIQFTSTSTRYRVRVRYASVTSIELNVNLGNSSIFTNTLPATAASLDNLQSGDFGYVEINNAFTSATGNIVGARNFSANAEVIIDRFEFIPVTATFEAEYDLERAQK

SEQ ID NO: 158 - protein, 657 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFLVGELWPSGRDPWEIFLEHVEQLVRQQITENARNTALARLQGLGASFRAYQQSLEDWLENRDDARTRSVLYTQYIALELDFLNAMPLFAINNQQVPLLMVYAQAANLHLLLLRDASLFGSEWGMASSDVNQYYQEQIRYTEEYSNHCVQWYNTGLNNLRGTNAESWLRYNQFRRDLTLGVLDLVALFPSYDTRTYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTQGLTNNTSINPVTLQFTSRDVYRTESNAGTNILFTTPVNGVPWARFNFINPQNIYERGATTYSQPYQGVGIQLFDSETELPPETTERPNYESYSHRLSHIGLIIGNTLRAPVYSWTHRSADRTNTIGPNRITQIPAVKGRFLFNGSVISGPGFTGGDVVRLNRNNGNIQNRGYIEVPIQFTSTSTRYRVRVRYASVTSIELNVNLGNSSIFTNTLPATAASLDNLQSGDFGYVEINNAFTSATGNIVGARNFSANAEVIIDRFEFIPVTATFEAEYDLERAQK

SEQ ID NO: 159 - protein, 657 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFLVGELWPSGRDPWEIFLEHVEQLIRQQVTENTRNTAIARLEGLGRGYRSYQQALETWLDNRNDARTRSVLYTQYIALELDFLNAMPLFAINNQQVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRTYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTQGLTNNTSINPVTLQFTSRDVYRTESNAGTNILFTTPVNGVPWARFNFINPQNIYERGATTYSQPYQGVGIQLFDSETELPPETTERPNYESYSHRLSHIGLIIGNTLRAPVYSWTHRSADRTNTIGPNRITQIPAVKGRFLFNGSVISGPGFTGGDVVRLNRNNGNIQNRGYIEVPIQFTSTSTRYRVRVRYASVTSIELNVNLGNSSIFTNTLPATAASLDNLQSGDFGYVEINNAFTSATGNIVGARNFSANAEVIIDRFEFIPVTATFEAEYDLERAQK

SEQ ID NO: 160 - protein, 657 aa, Artificial Sequence
  Cry1B variant
MPSNRKNENEIINALSIPAVSNHSAQMDLSLDARIEDSLCIAEGNNINPLVSASTVQTGINIAGRILGVLGVPFAGQLASFYSFLVGELWPSGRDPWEIFLEHVEQLVRQQITENARNTALARLQGLGASFRAYQQSLEDWLENRDDARSRSIILERYVALELDITTAIPLFRIRNEEVPLLMVYAQAANLHLLLLRDASLFGSEFGLTSQEIQRYYERQAEKTREYSDYCARWYNTGLNNLRGTNAESWLRYNQFRRDLTLGVLDLVALFPSYDTRTYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTQGLTNNTSINPVTLQFTSRDVYRTESNAGTNILFTTPVNGVPWARFNFINPQNIYERGATTYSQPYQGVGIQLFDSETELPPETTERPNYESYSHRLSHIGLIIGNTLRAPVYSWTHRSADRTNTIGPNRITQIPAVKGRFLFNGSVISGPGFTGGDVVRLNRNNGNIQNRGYIEVPIQFTSTSTRYRVRVRYASVTSIELNVNLGNSSIFTNTLPATAASLDNLQSGDFGYVEINNAFTSATGNIVGARNFSANAEVIIDRFEFIPVTATFEAEYDLERAQK

That which is claimed:

1. A variant Cry1B polypeptide comprising an amino acid sequence having at least 99% sequence identity to SEQ ID NO: 63, wherein the variant Cry 1B polypeptide comprises a Leucine (L) residue at position 518 and an Arginine (R) residue at position 553, and wherein the variant Cry1B polypeptide has increased insecticidal activity against corn earworm and/or fall armyworm compared to a Cry1B polypeptide comprising SEQ ID NO: 1.

2. The variant Cry1B polypeptide of claim 1, wherein the variant Cry1B polypeptide has increased insecticidal activity against corn earworm and/or fall armyworm compared to a Cry1B polypeptide comprising SEQ ID NO: 47.

3. The variant Cry1B polypeptide of claim 1, wherein the variant Cry 1B polypeptide has increased insecticidal activity against corn earworm and/or fall armyworm compared to a Cry1B polypeptide comprising SEQ ID NO: 41.

4. A recombinant polynucleotide encoding the variant Cry 1B polypeptide of claim 1.

5. The recombinant polynucleotide of claim 4, wherein its nucleic acid sequence has been optimized for expression in a plant.

6. A DNA construct comprising the polynucleotide of claim 4 operably linked to a heterologous regulatory element.

7. A transgenic plant comprising the DNA construct of claim 6.

8. A seed comprising the DNA construct of claim 6.

9. A composition comprising the variant Cry1B polypeptide of claim 1.

10. A method for controlling a Lepidopteran pest population comprising contacting said population with a pesticidally-effective amount of the variant Cry1B polypeptide of claim 1.

11. A method for killing a Lepidopteran pest comprising contacting said pest with, or feeding to said pest, a pesticidally-effective amount of the variant Cry 1B polypeptide of claim 1.

12. A plant or plant cell having stably incorporated into its genome the DNA construct of claim 6.

13. A method of protecting a plant from an insect pest, comprising introducing into said plant the DNA construct of claim 6.

* * * * *